US012595481B2

(12) United States Patent
Leventhal et al.

(10) Patent No.: US 12,595,481 B2
(45) Date of Patent: Apr. 7, 2026

(54) METHODS AND COMPOSITIONS FOR NEUROPROTECTION

(71) Applicant: DISARM THERAPEUTICS, INC., Cambridge, MA (US)

(72) Inventors: Liza Leventhal, Lexington, MA (US); Thomas Engber, Cambridge, MA (US); Raul Eduardo Krauss, Chestnut Hill, MA (US); Rajesh Devraj, Chesterfield, MO (US); Robert Owen Hughes, Newtown, CT (US); Todd Bosanac, New Milford, CT (US); Sudhir Agrawal, Shrewsbury, MA (US); Marco A. Passini, Northborough, MA (US)

(73) Assignee: DISARM THERAPEUTICS, INC., Cambridge, MA (US)

( * ) Notice: Subject to any disclaimer, the term of this patent is extended or adjusted under 35 U.S.C. 154(b) by 978 days.

(21) Appl. No.: 17/778,567

(22) PCT Filed: Nov. 25, 2020

(86) PCT No.: PCT/US2020/062289
§ 371 (c)(1),
(2) Date: May 20, 2022

(87) PCT Pub. No.: WO2021/108602
PCT Pub. Date: Jun. 3, 2021

(65) Prior Publication Data
US 2023/0242909 A1 Aug. 3, 2023

Related U.S. Application Data

(60) Provisional application No. 62/940,437, filed on Nov. 26, 2019.

(51) Int. Cl.
*C12N 15/113* (2010.01)
*A61P 25/28* (2006.01)

(52) U.S. Cl.
CPC ............ *C12N 15/113* (2013.01); *A61P 25/28* (2018.01); *C12N 2310/11* (2013.01); *C12N 2310/3125* (2013.01); *C12N 2310/314* (2013.01); *C12N 2310/315* (2013.01); *C12N 2310/316* (2013.01); *C12N 2310/531* (2013.01)

(58) Field of Classification Search
CPC .............. C12N 15/113; C12N 2310/11; C12N 2310/3125; C12N 2310/314; C12N 2310/315; C12N 2310/316; C12N 2310/531; C12N 2310/322; C12N 2310/341; C12N 2310/345; C12N 2310/3525; A61K 31/7088
See application file for complete search history.

(56) References Cited

U.S. PATENT DOCUMENTS

| | | | |
|---|---|---|---|
| 2004/0096830 A1 | 5/2004 | Dobie | |
| 2005/0244851 A1* | 11/2005 | Blume | C12Q 1/6876 |
| | | | 435/287.2 |
| 2006/0003322 A1* | 1/2006 | Bentwich | G16B 15/10 |
| | | | 435/6.16 |
| 2007/0050146 A1* | 3/2007 | Bentwich | C12Q 1/6809 |
| | | | 435/6.1 |
| 2007/0243546 A1* | 10/2007 | Cao | C12Q 1/6837 |
| | | | 435/6.12 |
| 2014/0079712 A1 | 3/2014 | Freeman et al. | |

FOREIGN PATENT DOCUMENTS

| | | |
|---|---|---|
| WO | 2012/178022 A2 | 12/2012 |
| WO | 2016/183041 A2 | 11/2016 |
| WO | 2017/164230 A1 | 9/2017 |
| WO | 2018/007980 A1 | 1/2018 |
| WO | 2018/057989 A1 | 3/2018 |
| WO | 2018/154413 A1 | 8/2018 |
| WO | 2019/079572 A1 | 4/2019 |
| WO | 2019079572 * | 4/2019 |
| WO | 2019/236879 A1 | 12/2019 |
| WO | 2019/236884 A1 | 12/2019 |
| WO | 2019/236890 A1 | 12/2019 |

OTHER PUBLICATIONS

Czech VL, O'Connor LC, Philippon B, Norman E, Byrne AB. TIR-1/SARM1 inhibits axon regeneration and promotes axon degeneration. Elife. Apr. 21, 2023.*
Sczakiel, Georg. "Theoretical and experimental approaches to design effective antisense oligonucleotides." Front. Biosci 5 (2000)).*
Watts, Jonathan K., and David R. Corey. "Gene silencing by siRNAs and antisense oligonucleotides in the laboratory and the clinic." The Journal of pathology 226.2 (2011)).*
International Search Report for PCT/US2020/062289.
Written Opinion for PCT/US2020/062289.
Office Action, CA Application No. 3,159,374, dated May 30, 2023, 4 pages.
Notice—Application Found Allowable, CA Application No. 3,159,374, dated Mar. 13, 2025, 1 page.
Notice of Reasons for Refusal, JP Application No. 2022-530807, dated Jul. 25, 2023, 7 pages.
Decision of Rejection, JP Application No. 2022-530807, dated Jan. 9, 2024, 2 pages.
Decision to Grant a Patent, JP Application No. 2022-530807, dated Jul. 9, 2024, 3 pages.
Examination Report, AU Application No. 2020391206, dated Jan. 10, 2024, 4 pages.
Notice of Reasons for Refusal, JP Application No. 2024-075968, dated Jun. 17, 2025, 4 pages.

(Continued)

*Primary Examiner* — Kimberly Chong
(74) *Attorney, Agent, or Firm* — Nielsen IP Law LLC

(57) ABSTRACT

The present invention relates to compositions and methods for treating neurodegeneration and neurodegenerative diseases associated with axonal degeneration. Neurodegeneration and neurodegenerative diseases associated with axonal degeneration are treated with therapies comprising SARM1 inhibitors such as SARM1 antisense oligonucleotides.

18 Claims, 7 Drawing Sheets

Specification includes a Sequence Listing.

(56)  References Cited

OTHER PUBLICATIONS

Geisler, S. et al., Prevention of vincristine-induced peripheral neuropathy by genetic deletion of SARM1 in mice, Brain, 2016, 3092-3108, 139.

Gerdts, J. et al., SARM1 Activation Triggers Axon Degeneration Locally via NAD+ Destruction, Science, Apr. 24, 2015, 453-457, 348, 6233.

Whitmore, A. et al., The Proapoptotic proteins Bax and Bak are not involved in Wallerian degeneration, Cell Death and Differentiation, 2003, 260-261, 10.

Gerdts, J. et al., Axon self destruction: new links among SARM1, MAPKs, and NAD+ metabolism, Neuron, Feb. 3, 2016, 449-460, 89, 3.

Sasaki, Y. et al., Characterization of Leber Congenital Amaurosis-associated NMNAT1 Mutants, The Journal of Biological Chemistry, Jul. 10, 2015, 17228-17238, 290, 28.

Gerdts, J. et al., Sarm1-Mediated Axon Degeneration Requires Both SAM and TIR Interactions, The Journal of Neuroscience, Aug. 14, 2013, 13569-13580, 33, 33.

Osterloh, J.M. et al., dSarm/Sarm1 Is Required for Activation of an Injury-Induced Axon Death Pathway, Science, Jul. 27, 2012, 481-484, 337, 6093.

Henninger, N. et al., Attenuated traumatic axonal injury and improved functional outcome after traumatic brain injury in mice lacking Sarm1, Brain, 2016, 1094-1105, 139.

* cited by examiner

METHODS AND COMPOSITIONS FOR NEUROPROTECTION

CROSS REFERENCE TO RELATED APPLICATIONS

This application claims the benefit of U.S. Provisional Application No. 62/940,437, filed Nov. 26, 2019, which is herein incorporated by reference in its entirety.

SEQUENCE LISTING

The instant application contains a Sequence Listing, which has been submitted electronically in ASCII format and is hereby incorporated by reference in its entirety. The ASCII copy, created Nov. 23, 2020 is named 2012800-0042_SL.txt, and is 652,394 bytes in size.

BACKGROUND

Axonal degeneration is a hallmark of several neurological disorders including peripheral neuropathies, traumatic brain injury, and neurodegenerative diseases (Gerdts et al., Science, 2015, 348:453-457, hereby incorporated by reference in its entirety). Neurodegenerative diseases and injuries are devastating to both patients and caregivers. Costs associated with these diseases currently exceed several hundred billion dollars annually in the Unites States alone. Since the incidence of many of these diseases and disorders increases with age, their incidence is rapidly increasing as demographics change.

SUMMARY OF THE INVENTION

The present invention is based, at least in part, on the insight that, following axonal damage, Sterile Alpha and TIR motif-containing 1 (SARM1) serves as the central executioner in the axonal degeneration pathway. The present invention provides, among other things, the recognition that antisense oligonucleotides that inhibit SARM1 are particularly beneficial for preventing axonal degeneration.

In one aspect, the present disclosure provides antisense oligonucleotides comprising a sequence having at least 80% identity to a sequence selected from a group consisting of SEQ ID NO: 3-21, 23-26, 38 and 39. In some embodiments, an antisense oligonucleotide comprises a sequence having at least 85% identity to a sequence selected from a group consisting of SEQ ID NO: 3-21, 23-26, 38 and 39. In some embodiments, an antisense oligonucleotide comprises a sequence having at least 90% identity to a sequence selected from a group consisting of SEQ ID NO: 3-21, 23-26, 38 and 39. In some embodiments, an antisense oligonucleotide comprises a sequence selected from a group consisting of SEQ ID NO: 3-21, 23-26, 38 and 39. In some embodiments, an antisense oligonucleotide comprises a sequence selected from a group consisting of SEQ ID NO: 3-2412.

In some embodiments, an antisense oligonucleotide comprises one or more modifications. In some embodiments, one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

In another aspect, the present disclosure comprises pharmaceutical compositions comprising antisense oligonucleotides of the present disclosure. In some embodiments, a pharmaceutical composition comprises a pharmaceutically acceptable carrier.

In another aspect, the present disclosure comprises methods for treating and/or preventing axonal degeneration in a subject, comprising: administering to the subject an antisense oligonucleotide is complementary to a target region of a nucleic acid encoding Sterile Alpha and TIR motif-containing 1 (SARM1).

In another aspect, the present disclosure comprises methods comprising administering to a subject at risk of developing a neurodegenerative disease or disorder an antisense oligonucleotide that is complementary to a target region of a nucleic acid encoding SARM1.

In some embodiments, a target nucleic acid encoding SARM1 is a SARM1 mRNA.

In some embodiments, an antisense oligonucleotide comprises a sequence having at least 80% identity to a sequence selected from a group consisting of SEQ ID NO: 3-21, 23-26, 38 and 39. In some embodiments, an antisense oligonucleotide comprises a sequence having at least 85% identity to a sequence selected from a group consisting of SEQ ID NO: 3-21, 23-26, 38 and 39. In some embodiments, an antisense oligonucleotide comprises a sequence having at least 90% identity to a sequence selected from a group consisting of SEQ ID NO: 3-21, 23-26, 38 and 39. In some embodiments, an antisense oligonucleotide comprises a sequence selected from a group consisting of SEQ ID NO: 3-21, 23-26, 38 and 39. In some embodiments, an antisense oligonucleotide comprises a sequence selected from a group consisting of SEQ ID NO: 3-2412.

In some embodiments, an antisense oligonucleotide comprises one or more modifications. In some embodiments, one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

In some embodiments, administering an antisense oligonucleotide decreases levels of SARM1 mRNA in the subject. In some embodiments, administering an antisense oligonucleotide decreases levels of SARM1 protein in the subject.

In some embodiments, a neurodegenerative disease or disorder comprises an acute or chronic disease or disorder of the peripheral nervous system (PNS), an acute or chronic disease or disorder of the central nervous system (CNS), or a disease associated with neurodegeneration.

In some embodiments, a neurodegenerative disease or disorder comprises a chronic disease or disorder of the PNS. In some embodiments, a chronic disease or disorder of the PNS comprises a systemic disorder, a pain disorder, or a metabolic disease or disorder. In some embodiments, a chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies. In some embodiments, a systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa. In some embodiments, a pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes. In some embodiments, a metabolic disease or disorder comprises diabetes mellitus, hypoglycemia, uremia, hypothyroidism, hepatic failure, polycythemia, amyloidosis, acromegaly, *porphyria*, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

In some embodiments, a neurodegenerative disease or disorder comprises an acute disease or disorder of the peripheral nervous system. In some embodiments, an acute disease or disorder of the PNS is the result of a mechanical injury, thermal injury, or injury from a chemical agent or chemotherapy. In some embodiments, a mechanical injury comprises a compression or entrapment injury or a pressure injury. In some embodiments, a compression or entrapment injury comprises carpal tunnel syndrome, direct trauma, a penetrating injury, a contusion, a fracture or a dislocated bone. In some embodiments, a pressure injury comprises pressure involving superficial nerves, pressure from a tumor or increased intraocular pressure. In some embodiments, a chemical agent or chemotherapy comprises a cytotoxic anticancer agent, thalidomide, an epothilone, a taxane, a *vinca* alkaloid, a proteasome inhibitor, a platinum-based drug or an auristatin. In some embodiments, an epothilone is ixabepilone. In some embodiments, a taxane is paclitaxel or docetaxel. In some embodiments, a *vinca* alkaloid is vinblastine, vinorelbine, vincristine, or vindesine. In some embodiments, a proteasome inhibitor is bortezomib. In some embodiments, a platinum-based drug is cisplatin, oxaliplatin, or carboplatin. In some embodiments, an auristatin is conjugated monomethyl auristatin E.

In some embodiments, a neurodegenerative disease or disorder comprises a chronic disease or disorder of the CNS. In some embodiments, a chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

In some embodiments, a chronic disease or disorder of the CNS comprises an optic nerve disorder, a traumatic CNS injury, or a metabolic disease or disorder. In some embodiments, an optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide. In some embodiments, a traumatic CNS injury comprises a traumatic brain injury (TBI), a spinal cord injury, traumatic axonal injury or chronic traumatic encephalopathy (CTE). In some embodiments, a metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

In some embodiments, a neurodegenerative disease or disorder comprises an acute disease or disorder of the CNS. In some embodiments, an acute disease or disorder of the CNS comprises an ischemia, a traumatic CNS injury, injury from a chemical agent, thermal injury, or viral encephalitis. In some embodiments, an ischemia comprises cerebral ischemia, hypoxic demyelination, ischemic demyelination, ischemic optic neuropathy, or non-arteritic anterior ischemic optic neuropathy. In some embodiments, a traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer. In some embodiments, a viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia). In some embodiments, a neurodegenerative disease or disorder results from blood clotting issues, inflammation, obesity, aging, stress, cancer, or diabetes.

In some embodiments, a subject is a human. In some embodiments, a subject is a patient with one or more risk factors for developing a condition involving axonal degeneration. In some embodiments, one or more risk factors for developing a condition involving axonal degeneration comprise age, one or more genetic risk factors for neurodegeneration, family history, engaging in one or more high-risk activities, one or more biomarkers of neurodegeneration, or a combination thereof. In some embodiments, one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof. In some embodiments, engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing. In some embodiments, one or more biomarkers of neurodegeneration comprise: concentration of neurofilament light chain protein (NF-L) in one or more of: a cerebrospinal fluid (CSF) sample, a blood sample, and a plasma sample from the subject; concentration of neurofilament heavy chain protein (NF-H) in one or more of: a cerebrospinal fluid (CSF) sample, a blood sample, and a plasma sample from the subject; concentration of Ubiquitin C-terminal Hydrolase L1 (UCH-L1) in one or more of: a cerebrospinal fluid (CSF) sample, a blood sample, and a plasma sample from the subject; concentration of alpha-synuclein in one or more of: a cerebrospinal fluid (CSF) sample, a blood sample, and a plasma sample from the subject; constitutive NAD+ levels in neurons and/or axons of the subject; constitutive cADPR levels in neurons and/or axons of the subject; levels of albumin, amyloid-β (Aβ)38, Aβ40, Aβ42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)α, sAPPβ, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

BRIEF DESCRIPTION OF THE DRAWING

The foregoing and other features and advantages of the present invention will be more fully understood from the following detailed description of illustrative embodiments taken in conjunction with the accompanying drawings. It should be understood that the present invention is not limited to the precise arrangements and instrumentalities of the embodiments shown in the drawings.

DEFINITIONS

Figure 1:
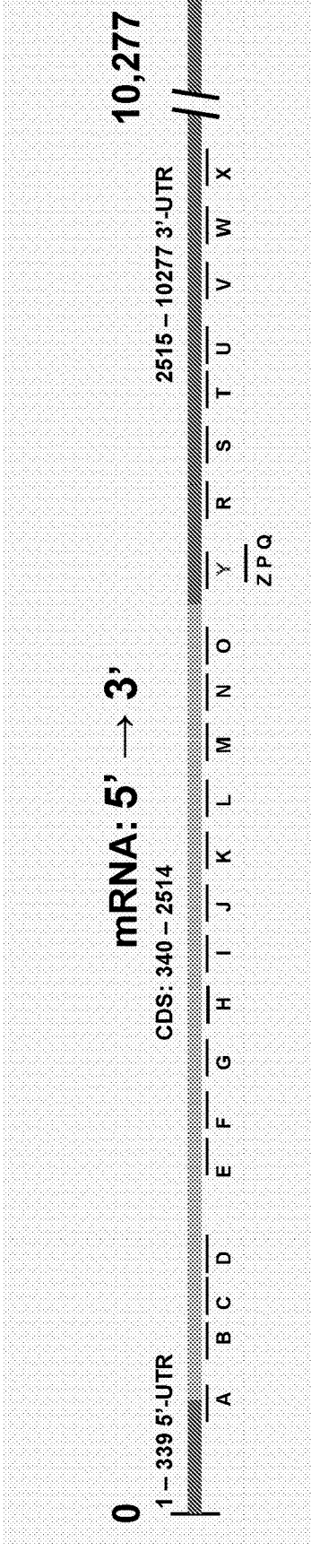
FIG. 1 shows a map of antisense oligonucleotides complementary to human SARM1 mRNA.

Binding: It will be understood that the term "binding", as used herein, typically refers to an association (e.g., a non-covalent or covalent association) between or among two or more entities. "Direct" binding involves physical contact between entities or moieties; indirect binding involves physical interaction by way of physical contact with one or more intermediate entities. Binding between two or more entities can typically be assessed in any of a variety of contexts-including where interacting entities or moieties are studied in isolation or in the context of more complex systems (e.g., while covalently or otherwise associated with a carrier entity and/or in a biological system or cell).

Biological Sample: As used herein, the term "biological sample" typically refers to a sample obtained or derived from a biological source (e.g., a tissue or organism or cell culture) of interest, as described herein. In some embodiments, a source of interest comprises an organism, such as an animal or human. In some embodiments, a biological sample is or comprises biological tissue or fluid. In some embodiments, a biological sample may be or comprise bone marrow; blood; blood cells; ascites; tissue or fine needle biopsy samples; cell-containing body fluids; free floating nucleic acids; sputum; saliva; urine; cerebrospinal fluid, peritoneal fluid; pleural fluid; feces; lymph; gynecological fluids; skin swabs; vaginal swabs; oral swabs; nasal swabs; washings or lavages such as a ductal lavages or broncheoalveolar lavages; aspirates; scrapings; bone marrow specimens; tissue biopsy specimens; surgical specimens; other body fluids, secretions, and/or excretions; and/or cells therefrom, etc. In some embodiments, a biological sample is or comprises cells obtained from an individual. In some embodiments, obtained cells are or include cells from an individual from whom the sample is obtained. In some embodiments, a sample is a "primary sample" obtained directly from a source of interest by any appropriate means. For example, in some embodiments, a primary biological sample is obtained by methods selected from the group consisting of biopsy (e.g., fine needle aspiration or tissue biopsy), surgery, collection of body fluid (e.g., blood, lymph, feces etc.), etc. In some embodiments, as will be clear from context, the term "sample" refers to a preparation that is obtained by processing (e.g., by removing one or more components of and/or by adding one or more agents to) a primary sample. For example, filtering using a semi-permeable membrane. Such a "processed sample" may comprise, for example, nucleic acids or proteins extracted from a sample or obtained by subjecting a primary sample to techniques such as amplification or reverse transcription of mRNA, isolation and/or purification of certain components, etc.

Biomarker: The term "biomarker" is used herein to refer to a to an entity, event, or characteristic whose presence, level, degree, type, and/or form, correlates with a particular biological event or state of interest, so that it is considered to be a "marker" of that event or state. To give but a few examples, in some embodiments, a biomarker may be or comprise a marker for a particular disease state, or for likelihood that a particular disease, disorder or condition may develop, occur, or reoccur. In some embodiments, a biomarker may be or comprise a marker for a particular disease or therapeutic outcome, or likelihood thereof. Thus, in some embodiments, a biomarker is predictive, in some embodiments, a biomarker is prognostic, in some embodiments, a biomarker is diagnostic, of the relevant biological event or state of interest. A biomarker may be or comprise an entity of any chemical class, and may be or comprise a combination of entities. For example, in some embodiments, a biomarker may be or comprise a nucleic acid, a polypeptide, a lipid, a carbohydrate, a small molecule, an inorganic agent (e.g., a metal or ion), or a combination thereof. In some embodiments, a biomarker is a cell surface marker. In some embodiments, a biomarker is intracellular. In some embodiments, a biomarker is detected outside of cells (e.g., is secreted or is otherwise generated or present outside of cells, e.g., in a body fluid such as blood, urine, tears, saliva, cerebrospinal fluid, etc. In some embodiments, a biomarker may be or comprise a genetic or epigenetic signature. In some embodiments, a biomarker may be or comprise a gene expression signature.

In some embodiments, a biomarker may be or comprise a marker for neurodegeneration, or for likelihood that a neurodegenerative disease, disorder or condition may develop, occur, or reoccur. In some embodiments, a biomarker may be or comprise a marker of neurodegeneration a therapeutic outcome, or likelihood thereof. Thus, in some embodiments, a biomarker is predictive, in some embodiments, a biomarker is prognostic, and in some embodiments, a biomarker is diagnostic, of a neurodegenerative disease, disorder or condition. In some embodiments changes in biomarker levels can be detected via cerebral spinal fluid (CSF), plasma and/or serum. In some embodiments a biomarker can be a detectable signal produced by medical imaging techniques including, but not limited to, magnetic resonance imaging (MRI), positron emission-tomography (PET), and/or computed tomography (CT). In some embodiments, a biomarker can be a detectable change in electrophysiological properties.

In some embodiments, neurodegeneration may be assessed, for example, by detecting an increase and/or decrease in the concentration of neurofilament light chain protein (NF-L) and/or neurofilament heavy chain protein (NF-H) contained in bodily fluids from a subject including, but not limited to, cerebral spinal fluid, blood, serum and/or plasma. In some embodiments, the incidence and/or progression of neurodegeneration can be assessed via positron emission tomography (PET) with a synaptic vesicle glycoprotein 2a (SV2A) ligand. In some embodiments, a detectable change in constitutive NAD+ and/or cADPR levels in neurons can be used to assess neurodegeneration.

In some embodiments, a detectable change in one or more neurodegeneration associated proteins in a subject, relative to a healthy reference population can be used as a biomarker of neurodegeneration. Such proteins include, but are not limited to, albumin, amyloid-β (Aβ)38, Aβ40, Aβ42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)α, sAPPβ, soluble triggering receptor expressed on myeloid cells (sTREM) 2, phospho-tau, and/or total-tau. In some embodiments, an increase in cytokines and/or chemokines, including, but not limited to, Ccl2, Ccl7, Ccl12, Csf1, and/or Il6, can be used as a biomarker of neurodegeneration.

Carrier: As used herein, the term "carrier" refers to a diluent, adjuvant, excipient, or vehicle with which a composition is administered. In some exemplary embodiments, carriers can include sterile liquids, such as, for example, water and oils, including oils of petroleum, animal, vegetable or synthetic origin, such as, for example, peanut oil, soybean oil, mineral oil, sesame oil and the like. In some embodiments, carriers are or include one or more solid components.

Combination: The terms "combination therapy" or "in combination with", as used herein, refer to those situations in which two or more different pharmaceutical agents for the treatment of disease are administered in overlapping regimens so that the subject is simultaneously exposed to at least two agents. In some embodiments, the different agents are administered simultaneously. In some embodiments, the administration of one agent overlaps the administration of at least one other agent. In some embodiments, the different agents are administered sequentially (e.g., all "doses" of a first regimen are administered prior to administration of any doses of a second regimen) such that the agents have simultaneous biologically activity within a subject. In some embodiments, "administration" of combination therapy may involve administration of one or more agent(s) or modality(ies) to a subject receiving the other agent(s) or modality(ies) in the combination. For clarity, combination therapy does not require that individual agents be administered together in a single composition (or even necessarily at the same time), although in some embodiments, two or more agents, or active moieties thereof, may be administered together in a combination composition, or even in a combination compound (e.g., as part of a single chemical complex or covalent entity).

Composition: Those skilled in the art will appreciate that the term "composition" may be used to refer to a discrete physical entity that comprises one or more specified components. In general, unless otherwise specified, a composition may be of any form—e.g., gas, gel, liquid, solid, etc.

Domain: The term "domain" as used herein refers to a section or portion of an entity. In some embodiments, a "domain" is associated with a particular structural and/or functional feature of the entity so that, when the domain is physically separated from the rest of its parent entity, it substantially or entirely retains the particular structural and/or functional feature. Alternatively or additionally, a domain may be or include a portion of an entity that, when separated from that (parent) entity and linked with a different (recipient) entity, substantially retains and/or imparts on the recipient entity one or more structural and/or functional features that characterized it in the parent entity. In some embodiments, a domain is a section or portion of a molecule (e.g., a small molecule, carbohydrate, lipid, nucleic acid, or polypeptide). In some embodiments, a domain is a section of a polypeptide; in some such embodiments, a domain is characterized by a particular structural element (e.g., a particular amino acid sequence or sequence motif, aa-helix character, ββ-sheet character, coiled-coil character, random coil character, etc.), and/or by a particular functional feature (e.g., binding activity, enzymatic activity, folding activity, signaling activity, etc.).

Dosage form or unit dosage form: Those skilled in the art will appreciate that the term "dosage form" may be used to refer to a physically discrete unit of an active agent (e.g., a therapeutic or diagnostic agent) for administration to a subject. Typically, each such unit contains a predetermined quantity of active agent. In some embodiments, such quantity is a unit dosage amount (or a whole fraction thereof) appropriate for administration in accordance with a dosing regimen that has been determined to correlate with a desired or beneficial outcome when administered to a relevant population (i.e., with a therapeutic dosing regimen). Those of ordinary skill in the art appreciate that the total amount of a therapeutic composition or agent administered to a particular subject is determined by one or more attending physicians and may involve administration of multiple dosage forms.

Dosing regimen or therapeutic regimen: Those skilled in the art will appreciate that the terms "dosing regimen" and "therapeutic regimen" may be used to refer to a set of unit doses (typically more than one) that are administered individually to a subject, typically separated by periods of time. In some embodiments, a given therapeutic agent has a recommended dosing regimen, which may involve one or more doses. In some embodiments, a dosing regimen comprises a plurality of doses each of which is separated in time from other doses. In some embodiments, individual doses are separated from one another by a time period of the same length; in some embodiments, a dosing regimen comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second dose amount same as the first dose amount. In some embodiments, a dosing regimen is correlated with a desired or beneficial outcome when administered across a relevant population (i.e., is a therapeutic dosing regimen).

Excipient: as used herein, refers to a non-therapeutic agent that may be included in a pharmaceutical composition, for example, to provide or contribute to a desired consistency or stabilizing effect. Suitable pharmaceutical excipients include, for example, starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like.

Inhibitory agent: As used herein, the term "inhibitory agent" refers to an entity, condition, or event whose presence, level, or degree correlates with decreased level or activity of a target. In some embodiments, an inhibitory agent may act directly (in which case it exerts its influence directly upon its target, for example, by binding to the target); in some embodiments, an inhibitory agent may act indirectly (in which case it exerts its influence by interacting with and/or otherwise altering a regulator of the target, so that level and/or activity of the target is reduced). In some embodiments, an inhibitory agent is one whose presence or level correlates with a target level or activity that is reduced relative to a particular reference level or activity (e.g., that observed under appropriate reference conditions, such as presence of a known inhibitory agent, or absence of the inhibitory agent in question, etc.).

Neurodegeneration: As used herein, the term "neurodegeneration" refers to a reduction in one or more features, structures, function, or characteristics of a neuron or neuronal tissue. In some embodiments, neurodegeneration is observed as a pathological reduction in an organism. Those skilled in the art will appreciate that neurodegeneration is associated with certain diseases, disorders and conditions, including those that affect humans. In some embodiments, neurodegeneration may be transient (e.g., as sometimes occurs in association with certain infections and/or chemical or mechanical disruptions); in some embodiments, neurodegeneration may be chronic and/or progressive (e.g., as is often associated with certain diseases, disorders or conditions such as, but not limited to, Parkinson's disease, amyotrophic lateral sclerosis, multiple sclerosis, Huntington disease, or Alzheimer's disease). In some embodiments, neurodegeneration may be assessed, for example, by detecting in a subject an increase in a biomarker associated with neurodegeneration. In some embodiments, neurodegeneration may be assessed, for example, by detecting in a subject a decrease in a biomarker associated with neurodegeneration. Alternatively or additionally, in some embodiments, neurodegeneration may be assessed by magnetic resonance imaging (MRI), biomarkers contained in cerebral spinal fluid, or other biomarkers observed in subjects. In some embodiments, neurodegeneration is defined as a score below 24 on the mini-mental state examination. In some embodiments, neurodegeneration refers to loss of synapses. In some embodiments, neurodegeneration refers to a reduction in neural tissue relating to a traumatic injury (e.g. exposure to an external force which disrupts the integrity of the neural tissue). In some embodiments, neurodegeneration refers to a reduction in peripheral neural tissue. In some embodiments, neurodegeneration refers to a reduction in central nervous tissue.

Nucleic acid: As used herein, in its broadest sense, refers to any compound and/or substance that is or can be incorporated into an oligonucleotide chain. In some embodiments, a nucleic acid is a compound and/or substance that is or can be incorporated into an oligonucleotide chain via a phosphodiester linkage. As will be clear from context, in some embodiments, "nucleic acid" refers to an individual nucleic acid residue (e.g., a nucleotide and/or nucleoside); in some embodiments, "nucleic acid" refers to an oligonucleotide chain comprising individual nucleic acid residues. In some embodiments, a "nucleic acid" is or comprises RNA; in some embodiments, a "nucleic acid" is or comprises DNA. In some embodiments, a nucleic acid is, comprises, or consists of one or more natural nucleic acid residues. In some embodiments, a nucleic acid is, comprises, or consists of one or more nucleic acid analogs. In some embodiments, a nucleic acid analog differs from a nucleic acid in that it does not utilize a phosphodiester backbone. For example, in some embodiments, a nucleic acid is, comprises, or consists of one or more "peptide nucleic acids", which are known in the art and have peptide bonds instead of phosphodiester bonds in the backbone, and are considered within the scope of the present invention. Alternatively or additionally, in some embodiments, a nucleic acid has one or more phosphorothioate and/or 5'-N-phosphoramidite linkages rather than phosphodiester bonds. In some embodiments, a nucleic acid is, comprises, or consists of one or more natural nucleosides (e.g., adenosine, thymidine, guanosine, cytidine, uridine, deoxyadenosine, deoxythymidine, deoxyguanosine, and deoxycytidine). In some embodiments, a nucleic acid is, comprises, or consists of one or more nucleoside analogs (e.g., 2-aminoadenosine, 2-thiothymidine, inosine, pyrrolo-pyrimidine, 3-methyl adenosine, 5-methylcytidine, C-5 propynyl-cytidine, C-5 propynyl-uridine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, 2-thiocytidine, methylated bases, intercalated bases, and combinations thereof). In some embodiments, a nucleic acid comprises one or more modified sugars (e.g., 2'-fluororibose, ribose, 2'-deoxyribose, arabinose, and hexose) as compared with those in natural nucleic acids. In some embodiments, a nucleic acid has a nucleotide sequence that encodes a functional gene product such as an RNA or protein. In some embodiments, a nucleic acid includes one or more introns. In some embodiments, nucleic acids are prepared by one or more of isolation from a natural source, enzymatic synthesis by polymerization based on a complementary template (in vivo or in vitro), reproduction in a recombinant cell or system, and chemical synthesis. In some embodiments, a nucleic acid is at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000 or more residues long. In some embodiments, a nucleic acid is partly or wholly single stranded; in some embodiments, a nucleic acid is partly or wholly double stranded. In some embodiments a nucleic acid has a nucleotide sequence comprising at least one element that encodes, or is the complement of a sequence that encodes, a polypeptide. In some embodiments, a nucleic acid has enzymatic activity. In some embodiments, a nucleic acid comprises a small interfering RNA (siRNA), a short hairpin RNA (shRNA), an antisense oligonucleotide, a microRNA, a gapmer, or an aptamer.

Oral: The phrases "oral administration" and "administered orally" as used herein have their art-understood meaning referring to administration by mouth of a compound or composition.

Parenteral: The phrases "parenteral administration" and "administered parenterally" as used herein have their art-understood meaning referring to modes of administration other than enteral and topical administration, usually by injection, and include, without limitation, intravenous, intramuscular, intra-arterial, intrathecal, intracapsular, intraorbital, intracardiac, intradermal, intraperitoneal, transtracheal, subcutaneous, subcuticular, intraarticulare, subcapsular, subarachnoid, intraspinal, and intrasternal injection and infusion.

Patient: As used herein, the term "patient" refers to any organism to which a provided composition is or may be administered, e.g., for experimental, diagnostic, prophylactic, cosmetic, and/or therapeutic purposes. Typical patients include animals (e.g., mammals such as mice, rats, rabbits, non-human primates, and/or humans). In some embodiments, a patient is a human. In some embodiments, a patient is suffering from or susceptible to one or more disorders or conditions. In some embodiments, a patient displays one or more symptoms of a disorder or condition. In some embodiments, a patient has been diagnosed with one or more disorders or conditions. In some embodiments, the patient is receiving or has received certain therapy to diagnose and/or to treat a disease, disorder, or condition.

Pharmaceutical composition: As used herein, the term "pharmaceutical composition" refers to an active agent, formulated together with one or more pharmaceutically acceptable carriers. In some embodiments, the active agent is present in unit dose amount appropriate for administration in a therapeutic or dosing regimen that shows a statistically significant probability of achieving a predetermined therapeutic effect when administered to a relevant population. In some embodiments, pharmaceutical compositions may be specially formulated for administration in solid or liquid form, including those adapted for the following: oral administration, for example, drenches (aqueous or non-aqueous solutions or suspensions), tablets, e.g., those targeted for buccal, sublingual, and systemic absorption, boluses, powders, granules, pastes for application to the tongue; parenteral administration, for example, by subcutaneous, intramuscular, intravenous or epidural injection as, for example, a sterile solution or suspension, or sustained-release formulation; topical application, for example, as a cream, ointment, or a controlled-release patch or spray applied to the skin, lungs, or oral cavity; intravaginally or intrarectally, for example, as a pessary, cream, or foam; sublingually; ocularly; transdermally; or nasally, pulmonary, and to other mucosal surfaces.

Pharmaceutically acceptable: As used herein, the phrase "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable carrier: As used herein, the term "pharmaceutically acceptable carrier" means a pharmaceutically-acceptable material, composition or vehicle, such as a liquid or solid filler, diluent, excipient, or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; pH buffered solutions; polyesters, polycarbonates and/or polyanhydrides; and other non-toxic compatible substances employed in pharmaceutical formulations.

Pharmaceutically acceptable salt: The term "pharmaceutically acceptable salt", as used herein, refers to salts of such compounds that are appropriate for use in pharmaceutical contexts, i.e., salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, S. M. Berge, et al. describes pharmaceutically acceptable salts in detail in *J. Pharmaceutical Sciences*, 66:1-19 (1977). In some embodiments, pharmaceutically acceptable salts include, but are not limited to, nontoxic acid addition salts, which are salts of an amino group formed with inorganic acids such as hydrochloric acid, hydrobromic acid, phosphoric acid, sulfuric acid and perchloric acid or with organic acids such as acetic acid, maleic acid, tartaric acid, citric acid, succinic acid or malonic acid or by using other methods used in the art such as ion exchange. In some embodiments, pharmaceutically acceptable salts include, but are not limited to, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. In some embodiments, pharmaceutically acceptable salts include, when appropriate, nontoxic ammonium, quaternary ammonium, and amine cations formed using counterions such as halide, hydroxide, carboxylate, sulfate, phosphate, nitrate, alkyl having from 1 to 6 carbon atoms, sulfonate and aryl sulfonate.

Prevent or prevention: As used herein, the terms "prevent" or "prevention", when used in connection with the occurrence of a disease, disorder, and/or condition, refer to reducing the risk of developing the disease, disorder and/or condition and/or to delaying onset of one or more characteristics or symptoms of the disease, disorder or condition. Prevention may be considered complete when onset of a disease, disorder or condition has been delayed for a predefined period of time.

Specific: The term "specific", when used herein with reference to an agent having an activity, is understood by those skilled in the art to mean that the agent discriminates between potential target entities or states. For example, in some embodiments, an agent is said to bind "specifically" to its target if it binds preferentially with that target in the presence of one or more competing alternative targets. In many embodiments, specific interaction is dependent upon the presence of a particular structural feature of the target entity (e.g., an epitope, a cleft, a binding site). It is to be understood that specificity need not be absolute. In some embodiments, specificity may be evaluated relative to that of the binding agent for one or more other potential target entities (e.g., competitors). In some embodiments, specificity is evaluated relative to that of a reference specific binding agent. In some embodiments, specificity is evaluated relative to that of a reference non-specific binding agent. In some embodiments, the agent or entity does not detectably bind to the competing alternative target under conditions of binding to its target entity. In some embodiments, a binding agent binds with higher on-rate, lower off-rate, increased affinity, decreased dissociation, and/or increased stability to its target entity as compared with the competing alternative target(s).

Subject: As used herein, the term "subject" refers to an organism, typically a mammal (e.g., a human, in some embodiments including prenatal human forms). In some embodiments, a subject is suffering from a relevant disease, disorder or condition. In some embodiments, a subject is susceptible to a disease, disorder, or condition. In some embodiments, a subject displays one or more symptoms or characteristics of a disease, disorder or condition. In some embodiments, a subject does not display any symptom or characteristic of a disease, disorder, or condition. In some embodiments, a subject is someone with one or more features characteristic of susceptibility to or risk of a disease, disorder, or condition. In some embodiments, a subject is a patient. In some embodiments, a subject is an individual to whom diagnosis and/or therapy is and/or has been administered.

Therapeutic agent: As used herein, the phrase "therapeutic agent" in general refers to any agent that elicits a desired pharmacological effect when administered to an organism. In some embodiments, an agent is considered to be a therapeutic agent if it demonstrates a statistically significant effect across an appropriate population. In some embodiments, the appropriate population may be a population of model organisms. In some embodiments, an appropriate population may be defined by various criteria, such as a certain age group, gender, genetic background, preexisting clinical conditions, etc. In some embodiments, a therapeutic agent is a substance that can be used to alleviate, ameliorate, relieve, inhibit, prevent, delay onset of, reduce severity of, and/or reduce incidence of one or more symptoms or features of a disease, disorder, and/or condition. In some embodiments, a "therapeutic agent" is an agent that has been or is required to be approved by a government agency before it can be marketed for administration to humans. In some embodiments, a "therapeutic agent" is an agent for which a medical prescription is required for administration to humans.

Treat: As used herein, the terms "treat," "treatment," or "treating" refer to any method used to partially or completely alleviate, ameliorate, relieve, inhibit, prevent, delay onset of, reduce severity of, and/or reduce incidence of one or more symptoms or features of a disease, disorder, and/or condition. Treatment may be administered to a subject who does not exhibit signs of a disease, disorder, and/or condition. In some embodiments, treatment may be administered to a subject who exhibits only early signs of the disease, disorder, and/or condition, for example, for the purpose of decreasing the risk of developing pathology associated with the disease, disorder, and/or condition. In some embodiments, treatment may be administered to a subject to prevent the risk of developing pathology associated with or resulting from a medical procedure and/or treatment.

DETAILED DESCRIPTION

Axonal Degeneration and SARM1

The present invention may be used to treat a subject who is suffering from or susceptible to axonal degeneration. Axonal degeneration is a major pathological feature of neurological diseases such as, but not limited to, Alzheimer's disease, Parkinson's disease, amyotrophic lateral sclerosis (ALS), multiple sclerosis, diabetic peripheral neuropathy, chemotherapy-induced peripheral neuropathy, inherited neuropathy, traumatic brain injury, and/or glaucoma. Damaged or unhealthy axons are eliminated via an intrinsic self-destruction program known as Wallerian degeneration, which is distinct from traditional cellular death pathways like apoptosis (Gerdts, J., et al., *Neuron,* 2016, 89, 449-460; Whitmore, A. et al., *Cell Death Differ.,* 2003, 10, 260-261, each of which is hereby incorporated by reference in its entirety). During Wallerian degeneration, a nerve undergoes selective breakdown of the axon segment distal to an injury, whereas the proximal axon segment and cell body remain intact. Axonal degeneration following an injury is characterized by the sequential depletion of NMNAT2, $NAD^+$ and ATP, followed by neurofilament proteolysis and axonal fragmentation occurring approximately 8 to 24 hours after the original injury (Gerdts, J., et al., *Neuron,* 2016, 89, 449-460, hereby incorporated by reference in its entirety).

It has recently been discovered that knocking-down or eliminating the expression of SARM1 leads to long-lasting protection of sensory neurons against injury-induced axonal degeneration (Gerdts et al., *J. Neurosci,* 2013, 33, 13569-13580, which is hereby incorporated by reference in its entirety). Following axonal damage, SARM1 serves as the central executioner in the axonal degeneration pathway. Activated SARM1 is a highly effective NADase that depletes local axonal $NAD^+$ reserves within minutes to a few hours after activation, leading to a local bioenergetic crisis, followed by rapid axonal degeneration. Activation of SARM1 via axonal injury or forced dimerization of SARM1-TIR domains promotes rapid and catastrophic depletion of $NAD^+$, followed soon after by axonal degeneration, which highlights the central role of $NAD^+$ homeostasis in axonal integrity (Gerdts, J., et al., *Science,* 2015, 348, 453-457). SARM1 is required for this injury-induced NAD$^+$ depletion both in vitro and in vivo and SARM1 activation triggers axon degeneration locally via NAD$^+$ destruction (Gerdts et al., et al., *Science,* 2015, 348, 452-457; Sasaki et al., *J. Biol. Chem.* 2015, 290, 17228-17238, each of which is hereby incorporated by reference in its entirety).

The protein sequence of wild-type human SARM1 is as follows:

```
                                      (SEQ ID NO: 1)
MVLTLLLSAYKLCRFFAMSGPRPGAERLAVPGPDGGGGTGPWWAAGGRGP

REVSPGAGTEVQDALERALPELQQALSALKQAGGARAVGAGLAEVFQLVE

EAWLLPAVGREVAQGLCDAIRLDGGLDLLLRLLQAPELETRVQAARLLEQ

ILVAENRDRVARIGLGVILNLAKEREPVELARSVAGILEHMFKHSEETCQ

RLVAAGGLDAVLYWCRRTDPALLRHCALALGNCALHGGQAVQRRMVEKRA

AEWLFPLAFSKEDELLRLHACLAVAVLATNKEVEREVERSGTLALVEPLV

ASLDPGRFARCLVDASDTSQGRGPDDLQRLVPLLDSNRLEAQCIGAFYLC

AEAAIKSLQGKTKVFSDIGAIQSLKRLVSYSTNGTKSALAKRALRLLGEE

VPRPILPSVPSWKEAEVQTWLQQIGFSKYCESFREQQVDGDLLLRLTEEE

LQTDLGMKSGITRKRFFRELTELKTFANYSTCDRSNLADWLGSLDPRFRQ

YTYGLVSCGLDRSLLHRVSEQQLLEDCGIHLGVHRARILTAAREMLHSPL

PCTGGKPSGDTPDVFISYRRNSGSQLASLLKVHLQLHGFSVFIDVEKLEA

GKFEDKLIQSVMGARNFVLVLSPGALDKCMQDHDCKDWVHKEIVTALSCG

KNIVPIIDGFEWPEPQVLPEDMQAVLTFNGIKWSHEYQEATIEKIIRFLQ

GRSSRDSSAGSDTSLEGAAPMGPT.
```

Genetic loss-of-function studies indicate that SARM1 serves as the central executioner of the axonal degeneration pathway following an injury. Genetic deletion or knockout of SARM1 allows for preservation of axons for 14 or more days after nerve transection (Osterloh, J. M., et al., *Science,* 2012, 337, 481-484; Gerdts, J., et al. *J. Neurosci.,* 2013, 33, 13569-13580, each of which is hereby incorporated by reference in its entirety) and also improves functional outcomes in mice after traumatic brain injury (Henninger, N. et al., *Brain,* 139, 2016, 1094-1105, which is hereby incorporated by reference in its entirety). In addition to the direct role SARM1 plays in axonal injury, SARM1 is also required for the axonal degeneration observed in chemotherapy-induced peripheral neuropathy (CIPN). Loss of SARM1 prevents CIPN, inhibiting both the axonal degeneration and the heightened pain sensitivity that develops after chemotherapeutic vincristine treatment (Geisler et al, *Brain,* 2016, 139, 3092-3108, which is hereby incorporated by reference in its entirety).

SARM1 Antisense Oligonucleotides

In some embodiments, the present disclosure provides antisense oligonucleotides. In some embodiments, an antisense oligonucleotide is an RNase H-dependent oligonucleotide, wherein the antisense oligonucleotide induces the degradation of mRNA. In some embodiments, an antisense oligonucleotide is a steric-blocker oligonucleotide, wherein the antisense oligonucleotide physically prevents or inhibits the progression of splicing or translational machinery. Antisense oligonucleotides of the present disclosure are capable of hybridizing to a target nucleic acid, resulting in at least one antisense activity. In some embodiments, antisense activity comprises degradation of a target nucleic acid by RNase H. In some embodiments, antisense activity comprises an antisense oligonucleotide physically preventing or inhibiting the progression of splicing or translational machinery.

In some embodiments, antisense oligonucleotides specifically hybridize to one or more target nucleic acids. In some embodiments, a target nucleic acid comprises a full-length mRNA. In some embodiments, a target nucleic acid comprises a region of an mRNA. In some embodiments, antisense oligonucleotides of the present invention hybridize to the same target nucleic acid. In some embodiments, antisense oligonucleotides of the present invention hybridize to different target nucleic acids. In some embodiments, a specifically hybridizing antisense oligonucleotide has a nucleobase sequence comprising a region having sufficient complementarity to a target nucleic acid to allow hybridization and result in antisense activity and insufficient complementarity to any non-target so as to avoid non-specific hybridization to any non-target nucleic acid sequences under conditions in which specific hybridization is desired (e.g., under physiological conditions for in vivo or therapeutic uses, and under conditions in which assays are performed in the case of in vitro assays).

In some embodiments, the present disclosure provides antisense oligonucleotides that are fully complementary to a target nucleic acid over the entire length of the antisense oligonucleotide. In some embodiments, an antisense oligonucleotide is 99% complementary to a target nucleic acid over the entire length of the antisense oligonucleotide. In some embodiments, an antisense oligonucleotide is 95% complementary to a target nucleic acid over the entire length of the antisense oligonucleotide. In some embodiments, an antisense oligonucleotide is 90% complementary to a target nucleic acid over the entire length of the antisense oligonucleotide. In some embodiments, an antisense oligonucleotide is 85% complementary to a target nucleic acid over the entire length of the antisense oligonucleotide. In some embodiments, an antisense oligonucleotide is 80% complementary to a target nucleic acid over the entire length of the antisense oligonucleotide. In some embodiments, an antisense oligonucleotide is between 80% and 99% complementary to a target nucleic acid over the entire length of the antisense oligonucleotide. In some embodiments, an antisense oligonucleotide comprises a region that is fully complementary to a target nucleic acid and is at least 80% complementary to the target nucleic acid over the entire length of the oligonucleotide. In some embodiments, the region of full complementarity is from 6 to 14 nucleobases in length.

In some embodiments, an antisense oligonucleotide comprises a sequence having at least 80% identity to a sequence selected from a group consisting of SEQ ID NO: 3-26. In some embodiments, an antisense oligonucleotide comprises a sequence having at least 85% identity to a sequence selected from a group consisting of SEQ ID NO: 3-26. In some embodiments, an antisense oligonucleotide comprises a sequence having at least 90% identity to a sequence selected from a group consisting of SEQ ID NO: 3-26. In some embodiments, an antisense oligonucleotide comprises a sequence selected from a group consisting of SEQ ID NO: 3-26. In some embodiments, an antisense oligonucleotide comprises a sequence selected from a group consisting of SEQ ID NO: 3-2081.

In some embodiments, an antisense oligonucleotide comprises a sequence having at least 80% identity to a sequence selected from a group consisting of SEQ ID NO: 3-21, 23-26, 38 and 39. In some embodiments, an antisense oligonucleotide comprises a sequence having at least 85% identity to a sequence selected from a group consisting of SEQ ID NO: 3-21, 23-26, 38 and 39. In some embodiments, an antisense oligonucleotide comprises a sequence having at least 90% identity to a sequence selected from a group consisting of SEQ ID NO: 3-21, 23-26, 38 and 39. In some embodiments, an antisense oligonucleotide comprises a sequence selected from a group consisting of SEQ ID NO: 3-21, 23-26, 38 and 39. In some embodiments, an antisense oligonucleotide comprises a sequence selected from a group consisting of SEQ ID NO: 3-2412.

In some embodiments, an antisense oligonucleotide comprises a sequence having at least 80% identity to a sequence selected from a group consisting of SEQ ID NO: 8, 9, 13, 22, 38, and 549. In some embodiments, an antisense oligonucleotide comprises a sequence having at least 85% identity to a sequence selected from a group consisting of SEQ ID NO: 8, 9, 13, 22, 38, and 549. In some embodiments, an antisense oligonucleotide comprises a sequence having at least 90% identity to a sequence selected from a group consisting of SEQ ID NO: 8, 9, 13, 22, 38, and 549. In some embodiments, an antisense oligonucleotide comprises a sequence selected from a group consisting of SEQ ID NO: 8, 9, 13, 22, 38, and 549.

In some embodiments, a target nucleic acid is an endogenous RNA molecule. In some embodiments, a target nucleic acid is an exogenous RNA molecule. In some embodiments, a target nucleic acid is a pre-mRNA. In some embodiments, a target nucleic acid is a mature mRNA. In some embodiments, a target nucleic acid is a SARM1 transcript.

In some embodiments, an antisense oligonucleotide of the present disclosure is complementary to a region of a SARM1 mRNA. In some embodiments, an antisense oligonucleotide is complementary to a region of a 5' untranslated region (UTR) of a SARM1 mRNA. In some embodiments, an antisense oligonucleotide is complementary to a coding region of a SARM1 mRNA. In some embodiments, an antisense oligonucleotide is complementary to a region of a 3' UTR of a SARM1 mRNA. In some embodiments, an antisense oligonucleotide of the present invention is complementary to a region of a SARM1 mRNA as illustrated in FIG. 1 and Table 1. Table 1 includes exemplary SARM1 antisense oligonucleotide sequences, region of complementarity in SAMR1 mRNA (5' UTR, coding region (CDS), or 3' UTR), oligonucleotide starting position (starting position from 5' end of SARM1 mRNA) and code letter corresponding to antisense oligonucleotide in FIG. 1.

TABLE 1

Antisense oligonucleotide sequences, region of complementarity and starting position

| SEQ ID NO: | Antisense Oligonucleotide Sequence (5'-3') | Region | Oligo Start | Code |
|---|---|---|---|---|
| 3 | GGCCTCCTCCACCAGTTGGA | CDS | 626 | B |
| 4 | GCAGGCTCTTGATGGCAGCC | CDS | 1395 | E |
| 5 | GCCATCCACCTGCTGCTCCC | CDS | 1640 | H |
| 6 | TCCCCACTGGGTTTGCCACC | CDS | 1999 | L |
| 7 | ACTTGCCTGCTTCCAGCTTC | CDS | 2127 | M |

TABLE 1-continued

Antisense oligonucleotide sequences, region of complementarity and starting position

| SEQ ID NO: | Antisense Oligonucleotide Sequence (5'-3') | Region | Oligo Start | Code |
|---|---|---|---|---|
| 8 | CTTGTCCAGTGCTCCAGGTG | CDS | 2204 | N |
| 9 | GCACAGCCTGCATGTCCTCA | CDS | 2346 | O |
| 10 | CCCAGGTTGTCTCAGCCCAG | 3'UTR | 2596 | Q |
| 11 | TCCCTTCCCTCTCCAGATAC | 3'UTR | 2688 | R |
| 12 | TGCAGAACCACCCCCACCCC | 3'UTR | 2814 | S |
| 13 | GCCCAGGCCCTTGCTCAGAA | 3'UTR | 2932 | T |
| 14 | GGCACTCATCCCTGGCTGGC | 3'UTR | 2958 | U |
| 15 | CCCCATGCCCAGACCCAGGC | 3'UTR | 3231 | W |
| 16 | GCCTCTTTCCACAGAGCTGC | 3'UTR | 3420 | X |
| 17 | TCTCAGCCACCAGGATCTGC | CDS | 786 | D |
| 18 | GAGCTCCCTAAAGAACCTCT | CDS | 1730 | J |
| 19 | CCAGGTTGTCTCAGCCCAGG | 3'UTR | 2595 | P |
| 20 | GGTGCAGCAGGGAGCGGTCC | CDS | 1869 | K |
| 21 | GCAGCGTCAGGACCATGGGC | 5'UTR | 336 | A |
| 22 | ACCAGGCGTTTCAGGCTCTG | CDS | 1453 | F |
| 23 | CACCTCCTCGCCCAGCAGGC | CDS | 1523 | G |
| 24 | GTCTGGAGTTCCTCCTCCGT | CDS | 1678 | I |
| 25 | CCCTCGCCCTGGATGTGGCA | 3'UTR | 3124 | V |
| 26 | GGCCTGCACACGCGTCTCCA | CDS | 752 | C |
| 38 | AGGTTGTCTCAGCCCAGGGA | 3'UTR | 2593 | Y |
| 39 | CAGGTTGTCTCAGCCCAGGG | 3'UTR | 2594 | Z |

In some embodiments, an antisense oligonucleotide of the present disclosure comprises an oligonucleotide consisting of 8 to 30 linked nucleosides and having a nucleobase sequence comprising a complementary region comprising at least 8 contiguous nucleobases complementary to a target region of equal length of a SARM1 transcript.

In some embodiments, an antisense oligonucleotide comprises RNA. In some embodiments, an antisense oligonucleotide comprises DNA. In some embodiments, an antisense oligonucleotide comprises both RNA and DNA. In some embodiments, an antisense oligonucleotide is between 5 and 100 nucleotides in length. In some embodiments, an antisense oligonucleotide is between 5 and 90 nucleotides in length. In some embodiments, an antisense oligonucleotide is between 5 and 80 nucleotides in length. In some embodiments, an antisense oligonucleotide is between 5 and 70 nucleotides in length. In some embodiments, an antisense oligonucleotide is between 5 and 60 nucleotides in length. In some embodiments, an antisense oligonucleotide is between 5 and 50 nucleotides in length. In some embodiments, an antisense oligonucleotide is between 5 and 40 nucleotides in length. In some embodiments, an antisense oligonucleotide is between 5 and 30 nucleotides in length. In some embodiments, an antisense oligonucleotide is between 5 and 25 nucleotides in length. In some embodiments, an antisense oligonucleotide is between 5 and 20 nucleotides in length. In some embodiments, an antisense oligonucleotide is between 5 and 15 nucleotides in length. In some embodiments, an antisense oligonucleotide is between 5 and 10 nucleotides in length. In some embodiments, an antisense oligonucleotide is between 10 and 100 nucleotides in length. In some embodiments, an antisense oligonucleotide is between 15 and 100 nucleotides in length. In some embodiments, an antisense oligonucleotide is between 20 and 100 nucleotides in length. In some embodiments, an antisense oligonucleotide is between 25 and 100 nucleotides in length. In some embodiments, an antisense oligonucleotide is between 30 and 100 nucleotides in length. In some embodiments, an antisense oligonucleotide is between 40 and 100 nucleotides in length. In some embodiments, an antisense oligonucleotide is between 50 and 100 nucleotides in length. In some embodiments, an antisense oligonucleotide is between 60 and 100 nucleotides in length. In some embodiments, an antisense oligonucleotide is between 70 and 100 nucleotides in length. In some embodiments, an antisense oligonucleotide is between 90 and 100 nucleotides in length. In some embodiments, an antisense oligonucleotide is 10, 11, 12, 13, 14, 15, 16, 17, 18, 19, 20, 21, 22, 23, 24, 25, 26, 27, 28, 29, or 30 nucleotides in length. In some embodiments, an antisense oligonucleotide is 20 nucleotides in length.

In some embodiments, an antisense oligonucleotide comprises one or more modifications. In some embodiments, one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof. In some embodiments, any antisense oligonucleotide described herein comprises internucleotide linkages of the following pattern (5' to 3'): $R_SR_OR_SR_OR_SD_SD_SD_SD_SD_SD_SD_SD_SD_SD_S$-$R_OR_SR_OR_S$, wherein $R_S$ is an RNA (2'-MOE) phosphorothioate bond, $R_O$ is an RNA (2'-MOE) phosphodiester bond and $D_S$ is a DNA phosophorothioate bond. In some embodiments, an antisense oligonucleotide comprises SEQ ID NO: 2410. In some embodiments, an antisense oligonucleotide comprises SEQ ID NO: 2411. In some embodiments, an antisense oligonucleotide comprises SEQ ID NO: 2412.

Methods of Treating Neurodegeneration

Methods described herein include treating and/or preventing axonal degeneration in a subject. In some embodiments, methods described herein include administering to the subject an SARM1 antisense agent. In some embodiments, methods described herein include administering to the subject an SARM1 antisense agent. Methods described herein include administering to a subject at risk of developing a neurodegenerative disease or disorder an SARM1 antisense agent. In some embodiments, an SARM1 antisense agent is an SARM1 antisense oligonucleotide.

Diseases, Disorders, and Conditions

In some embodiments, the present disclosure provides methods for treating subjects suffering from one or more diseases, disorders, or conditions. In some embodiments, the one or more diseases, disorders, or conditions are mediated by SARM1.

In some embodiments, a neurodegenerative disease or disorder comprises an acute or chronic disease or disorder of the peripheral nervous system (PNS), an acute or chronic disease or disorder of the central nervous system (CNS), or a disease associated with neurodegeneration.

In some embodiments, a neurodegenerative disease or disorder comprises an acute disease or disorder of the PNS.

In some embodiments, an acute disease or disorder of the PNS is the result of a mechanical injury, thermal injury, or injury from a chemical agent or chemotherapy. In some embodiments, a mechanical injury comprises a compression or entrapment injury or a pressure injury. In some embodiments, a compression or entrapment injury comprises carpal tunnel syndrome, direct trauma, a penetrating injury, a contusion, a fracture or a dislocated bone. In some embodiments, a pressure injury comprises pressure involving superficial nerves, pressure from a tumor or increased intraocular pressure. In some embodiments, a chemical agent or chemotherapy comprises a cytotoxic anticancer agent, thalidomide, an epothilone, a taxane, a vinca alkaloid, a proteasome inhibitor, a platinum-based drug or an auristatin. In some embodiments, an epothilone is ixabepilone. In some embodiments, a taxane is paclitaxel or docetaxel. In some embodiments, a vinca alkaloid is vinblastine, vinorelbine, vincristine, or vindesine. In some embodiments, a proteasome inhibitor is bortezomib. In some embodiments, a platinum-based drug is cisplatin, oxaliplatin, or carboplatin. In some embodiments, an auristatin is conjugated monomethyl auristatin E.

In some embodiments, a neurodegenerative disease or disorder comprises a chronic disease or disorder of the PNS. In some embodiments, a chronic disease or disorder of the PNS comprises a systemic disorder, a pain disorder, or a metabolic disease or disorder.

In some embodiments, a chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

In some embodiments, a systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

In some embodiments, a pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

In some embodiments, a metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

In some embodiments, a neurodegenerative disease or disorder comprises an acute disease or disorder of the CNS. In some embodiments, an acute disease or disorder of the CNS comprises an ischemia, a traumatic CNS injury, injury from a chemical agent, thermal injury, or viral encephalitis.

In some embodiments, an ischemia comprises cerebral ischemia, hypoxic demyelination, ischemic demyelination, ischemic optic neuropathy, or non-arteritic anterior ischemic optic neuropathy.

In some embodiments, a traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

In some embodiments, a viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

In some embodiments, a neurodegenerative disease or disorder comprises a chronic disease or disorder of the CNS.

In some embodiments, a chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

In some embodiments, a chronic disease or disorder of the CNS comprises an optic nerve disorder, a traumatic CNS injury, or a metabolic disease or disorder.

In some embodiments, an optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

In some embodiments, a traumatic CNS injury comprises a traumatic brain injury (TBI), a spinal cord injury, traumatic axonal injury or chronic traumatic encephalopathy (CTE).

In some embodiments, a metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

In some embodiments, a neurodegenerative disease or disorder comprises a disease associated with neurodegeneration. In some embodiments, a neurodegenerative disease or disorder results from blood clotting issues, inflammation, obesity, aging, stress, cancer, or diabetes.

In some embodiments, a subject is a human. In some embodiments, a subject is at risk of developing a condition characterized by axonal degeneration. In some embodiments, a subject is a patient with one or more risk factors for developing a condition involving axonal degeneration. In some embodiments, one or more risk factors for developing a condition involving axonal degeneration comprise age, one or more genetic risk factors for neurodegeneration, family history, engaging in one or more high-risk activities, one or more biomarkers of neurodegeneration, or a combination thereof.

In some embodiments, one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

In some embodiments, a subject has a condition characterized by axonal degeneration. In some embodiments, a subject has been diagnosed with a condition characterized by axonal degeneration.

In some embodiments, engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

In some embodiments, one or more biomarkers of neurodegeneration comprises: concentration of neurofilament light chain protein (NF-L) in one or more of: a cerebrospinal fluid (CSF) sample, a blood sample, and a plasma sample from the subject; concentration of neurofilament heavy chain protein (NF-H) in one or more of: a cerebrospinal fluid (CSF) sample, a blood sample, and a plasma sample from the subject; concentration of Ubiquitin C-terminal Hydrolase L1 (UCH-L1) in one or more of: a cerebrospinal fluid (CSF) sample, a blood sample, and a plasma sample from the subject; concentration of alpha-synuclein in one or more of: a cerebrospinal fluid (CSF) sample, a blood sample, and a plasma sample from the subject; constitutive $NAD^+$ levels in neurons and/or axons of the subject; constitutive cADPR levels in neurons and/or axons of the subject; levels of albumin, amyloid-$\beta$ (A$\beta$)38, A$\beta$40, A$\beta$42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)$\alpha$, sAPP$\beta$, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

In some embodiments, a therapy provided herein is characterized such that, when administered to a population of subjects, the therapy reduces one or more symptoms or features of neurodegeneration. For example, in some embodiments, a relevant symptom or feature may be selected from the group consisting of extent, rate, and/or timing of neuronal disruption.

Subjects

In some embodiments, a composition as described herein is administered to subjects suffering from or susceptible to a disease, disorder or condition as described herein; in some embodiments, such a disease, disorder or condition is characterized by axonal degeneration, such as one of the conditions mentioned herein.

In some embodiments, a subject to whom a composition is administered as described herein exhibits one or more signs or symptoms associated with axonal degeneration; in some embodiments, the subject does not exhibit any signs or symptoms of neurodegeneration.

In some embodiments, provided methods comprise administering a composition to a patient in need thereof. In some such embodiments, the patient is at risk of developing a condition characterized by axonal degeneration. In some embodiments, the patient has a condition characterized by axonal degeneration. In some embodiments, the patient has been diagnosed with a condition characterized by axonal degeneration.

In some embodiments, provided methods comprise administering a composition as described herein to a patient population of in need thereof. In some embodiments, the population is drawn from individuals who engage in activities where the potential for traumatic neuronal injury is high. In some embodiments, the population is drawn from athletes who engage in contact sports or other high-risk activities.

In some embodiments, the subject is at risk of developing a condition characterized by axonal degeneration. In some embodiments, the subject is identified as being at risk of axonal degeneration, e.g., based on the subject's genotype, a diagnosis of a condition associated with axonal degeneration, and/or exposure to an agent and/or a condition that induces axonal degeneration.

In some embodiments, the patient is at risk of developing a neurodegenerative disorder. In some embodiments the patient is elderly. In some embodiments, the patient is known to have a genetic risk factor for neurodegeneration. In some embodiments, the patient has a family history of neurodegenerative disease. In some embodiments, the patient expresses one or more copies of a known genetic risk factor for neurodegeneration (Lill et al., *Semin Neurol,* 2011, 31:531-541, hereby incorporated by reference in its entirety). In some embodiments, the patient is drawn from a population with a high incidence of neurodegeneration. For example, in some embodiments, the patient has a hexanucleotide repeat expansion in chromosome 9 open reading frame 72. In some embodiments, the patient has one or more copies of the Apolipoprotein E 4 (ApoE4) allele.

In some embodiments, the patient has one or more copies of a disease-causing mutation in APP, PSEN1, or PSEN2. In some embodiments, the patient has one or more copies of a disease-associated polymorphism in or near the following genes: ABCA7, APOE, BIN1, CD2AP, CD33, CLU, CR1, MS4A4E, MS4A6A, and PICALM.

In some embodiments, the patient has one or more copies of a disease-causing mutation in EIF4G1, LRRK2, PARK2, PARK7, PINK1, SNCA, or VPS35. In some embodiments, the patient has one or more copies of a disease-associated polymorphism in or near the following genes: ACMSD/TMEM163, BST1, CCDC62/HIP1R, FAM47E/STBD1, GAK/DGKQ, GBA, GPNMB, QWA_8p22/FGF20, HLA-II, LRRK2, MAPT, MCCC1/LAMP3, PARK16, SETD1A/STX1B, SNCA, SREBF1/RAI1, STK29, and SYT11/RAB25.

In some embodiments, the patient has one or more copies of a disease-causing mutation in C9ORF72, CHMP2B, GRN, MAPT, or VCP. In some embodiments, the patient has one or more copies of a disease-associated polymorphism in or near the TMEM106B gene.

Figure 4:
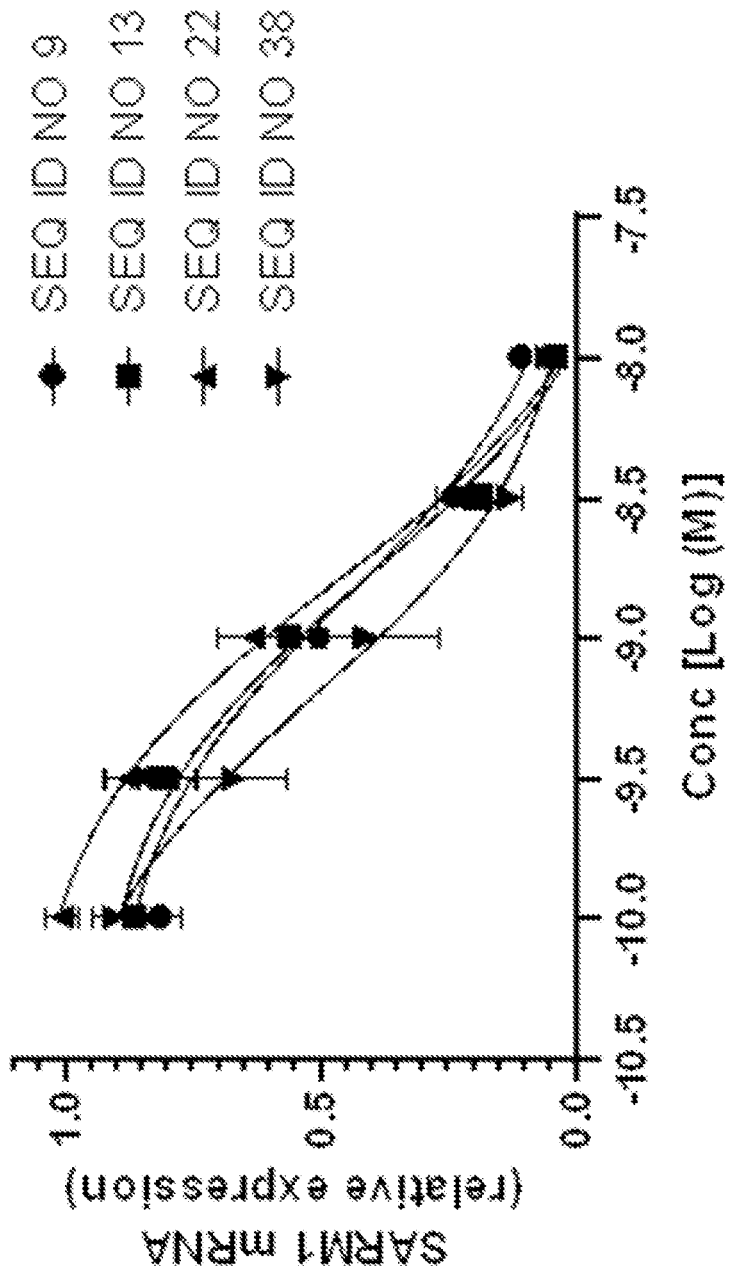
FIG. 4 shows a graph illustrating relative SARM1 mRNA expression in human induced pluripotent stem cells (IPSC)-derived motor neurons following transfection with antisense oligonucleotides targeting the SARM1 transcript.

In some embodiments, the patient has one or more copies of a disease-causing mutation in ANG, ALS2, C9ORF72, FIG. 4, FUS, OPTN, SETX, SOD1, SPG11, TARDBP, UBQLN2, VAPB, or VCP. In some embodiments, the patient has one or more copies of a disease-associated polymorphism in or near the following genes: GWA_9p21.2, UNC13A and ATXN2.

In some embodiments, subjects to which a composition as described herein is administered may be or comprise subjects suffering from or susceptible to a neurodegenerative disease, disorder or condition. In some embodiments, a neurodegenerative disease, disorder or condition may be or comprise a traumatic neuronal injury. In some embodiments, a traumatic neuronal injury is blunt force trauma, a closed-head injury, an open head injury, exposure to a concussive and/or explosive force, a penetrating injury in to the brain cavity or innervated region of the body. In some embodiments, a traumatic neuronal injury is a force which causes the axons to deform, stretch, crush or sheer.

In some embodiments, the subject engages in an activity identified as a risk factor for neuronal degeneration, e.g., a subject that engages in contact sports or occupations with a high chance for traumatic neuronal injury.

For example, the subject may be a patient who is receiving, or is prescribed, a chemotherapy associated with peripheral neuropathy. Examples of chemotherapeutic agents include, but are not limited to, thalidomide, epothilones (e.g., ixabepilone), taxanes (e.g., paclitaxel and docetaxel), vinca alkaloids (e.g., vinblastine, vinorelbine, vincristine, and vindesine), proteasome inhibitors (e.g., bortezomib), auristatins (e.g., Auristatin E) and platinum-based drugs (e.g., cisplatin, oxaliplatin, and carboplatin).

In some embodiments, provided methods comprise administering a composition as described herein to a patient or patient population based on the presence or absence of one or more biomarkers. In some embodiments, provided methods further comprise monitoring the level of a biomarker in a patient or patient population and adjusting the dosing regimen accordingly.

Dosing

Those of skill in the art will appreciate that, in some embodiments, the exact amount of a particular SARM1 antisense agent included in and/or delivered by administration of a pharmaceutical composition or regimen as described herein may be selected by a medical practitioner and may be different for different subjects, for example, upon consideration of one or more of species, age, and general condition of the subject, and/or identity of the particular SARM1 antisense agent, its mode of administration, and the like. Alternatively, in some embodiments, the amount of an SARM1 antisense agent included in and/or delivered by administration of a pharmaceutical composition or regimen as described herein may be standardized across a relevant patient population (e.g., all patients, all patients of a particular age or stage of disease or expressing a particular biomarker, etc.).

A provided SARM1 antisense agent or composition of the present disclosure is preferably formulated in dosage unit form for ease of administration and uniformity of dosage. The expression "dosage unit form" as used herein refers to a physically discrete unit of agent appropriate for the patient to be treated. It will be understood, however, that the total daily usage of a provided SARM1 antisense agent or composition of the present disclosure will be decided by the attending physician within the scope of sound medical judgment. The specific effective dose level for any particular patient or organism will depend upon a variety of factors including the disorder being treated and the severity of the disorder; the clinical condition of the individual patient; the cause of the disorder; the activity of the specific SARM1 antisense agent employed; the specific composition employed; the age, body weight, general health, sex and diet of the patient; the time of administration, delivery site of the agent, route of administration, and rate of degradation of the specific SARM1 antisense agent employed; the duration of the treatment; drugs used in combination or coincidental with the specific SARM1 antisense agent employed, and like factors well known in the medical arts. In some embodiments, the effective amount of the SARM1 antisense agent to be administered will be governed by such considerations, and is the minimum amount necessary to inhibit SARM1 activity, inflammatory activity, necroptosis or immune activity as required to prevent or treat the undesired disease or disorder, such as for example, neurodegeneration or traumatic neural injury.

In some embodiments, compositions of the present disclosure may be administered orally, parenterally, by inhalation spray, topically, rectally, nasally, buccally, vaginally or via an implanted reservoir. The term "parenteral" as used herein includes subcutaneous, intravenous, intramuscular, intra-articular, intra-synovial, intrasternal, intrathecal, intrahepatic, intradermal, intraocular, intravitreal, intralesional and intracranial injection or infusion techniques. Preferably, the compositions are administered via intrathecal, intraventricular, intracerebroventricular, intracisternal, intraparenchymal or intravitreal injection.

In some embodiments, pharmaceutically acceptable compositions of this disclosure may also be administered topically, especially when the target of treatment includes areas or organs readily accessible by topical application, including diseases of the eye, the skin, or the lower intestinal tract. Suitable topical formulations are readily prepared for each of these areas or organs.

The daily dose is, in certain embodiments, given as a single daily dose or in divided doses two to six times a day, or in sustained release form. This dosage regimen may be adjusted to provide the optimal therapeutic response. In some embodiments, compositions of the present disclosure can be delivered four times a week, three times a week, twice a week, once a week, every ten days, every two weeks, every three weeks, or more preferably every four weeks, once a month, every six weeks, every eight weeks, every other month, every three months, every four months, every six months, every eight months, every nine months or annually.

Compositions of the present disclosure may be administered in combination with other therapeutic agents. Those additional agents may be administered separately from a provided SARM1 antisense agent or composition thereof, as part of a multiple dosage regimen. Alternatively, those agents may be part of a single dosage form, mixed together with a provided SARM1 antisense agent in a single composition. If administered as part of a multiple dosage regime, the two active agents may be submitted simultaneously, sequentially or within a period of time from one another, normally within five hours from one another.

It should also be understood that a specific dosage and treatment regimen for any particular patient may depend upon a variety of factors, including the activity of the specific SARM1 antisense agent employed, the age, body weight, general health, sex, diet, time of administration, rate of excretion, drug combination, and the judgment of the treating physician and the severity of the particular disease being treated. In some embodiments, the amount of an SARM1 antisense agent of the present disclosure in the composition will also depend upon the particular SARM1 antisense agent in the composition.

In some embodiments, SARM1 antisense agents as described herein may be utilized in combination with one or more other therapies to treat a relevant disease, disorder, or condition. In some embodiments, dosing of an SARM1 antisense agent is altered when utilized in combination therapy as compared with when administered as monotherapy; alternatively or additionally, in some embodiments, a therapy that is administered in combination with an SARM1 antisense agent as described herein is administered according to a regimen or protocol that differs from its regimen or protocol when administered alone or in combination with one or more therapies other than an SARM1 antisense agent of the present disclosure. In some embodiments, compositions which comprise an additional therapeutic agent, that additional therapeutic agent and a provided SARM1 antisense agent may act synergistically. In some embodiments, one or both therapies utilized in a combination regimen are administered at a lower level or less frequently than when they are utilized individually as monotherapies.

In some embodiments, the present disclosure relates to a method of treating, preventing, and/or ameliorating a neurodegenerative disease, disorder or condition comprising i) providing a) a subject diagnosed with, at risk for, or exhibiting symptoms of, a neurodegenerative disease, disorder or condition and b) a combination comprising a SARM1 antisense oligonucleotide and a SARM1 inhibitor. In some embodiments, the present disclosure provides a combination therapy comprising a SARM1 antisense oligonucleotide and a SARM1 inhibitor; and ii) administering said combination to said subject under conditions such that said neurodegenerative disease, disorder or condition is reduced. In some embodiments, a SARM1 antisense oligonucleotide and a SARM1 inhibitor act synergistically in treating, preventing, and/or ameliorating a neurodegenerative disease, disorder or condition. In some embodiments, a SARM1 inhibitor is a small molecule.

In some embodiments, the present disclosure relates to a method of treating, preventing, and/or ameliorating a neurodegenerative disease, disorder or condition comprising i) providing a) a subject diagnosed with, at risk for, or exhibiting symptoms of, a neurodegenerative disease, disorder or condition and b) a combination comprising a SARM1 antisense oligonucleotide and NAD+ or a NAD+ precursor (e.g., NR, NRH, NA, NaR, NAM, NMN, NaMN, TRP, vitamin $B_3$, or NAAD); and ii) administering said combination to said subject under conditions such that said neurodegenerative disease, disorder or condition is reduced. In some embodiments, the present disclosure provides a combination therapy comprising a SARM1 antisense oligonucleotide and NAD+ or a NAD+ precursor (e.g., NR, NRH, NA, NaR, NAM, NMN, NaMN, TRP, vitamin B3, or NAAD). In some embodiments, a SARM1 antisense oligonucleotide and NAD+ or a NAD+ precursor (e.g., NR, NRH, NA, NaR, NAM, NMN, NaMN, TRP, vitamin $B_3$, or NAAD) act synergistically in treating, preventing, and/or ameliorating a neurodegenerative disease, disorder or condition.

In some embodiments, the present disclosure relates to a method of treating, preventing, and/or ameliorating a neurodegenerative disease, disorder or condition comprising i) providing a) a subject diagnosed with, at risk for, or exhibiting symptoms of, a neurodegenerative disease, disorder or condition and b) a combination comprising a SARM1 antisense oligonucleotide and any biologic agent known in the art (e.g., but not limited to, an antibody, aptamer, trophic factor, or antisense oligonucleotide against a target other than SARM1); and ii) administering said combination to said subject under conditions such that said neurodegenerative disease, disorder or condition is reduced.

In some embodiments, an SARM1 antisense agent and/or compositions comprising a SARM1 agent described herein are administered with a chemotherapeutic agent including, but not limited to, alkylating agents, anthracyclines, taxanes, epothilones, histone deacetylase inhibitors, topoisomerase inhibitors, kinase inhibitors, nucleotide analogs, peptide antibiotics, platinum-based agents, retinoids, vinca alkaloids and derivatives. In some embodiments, an SARM1 antisense agent and/or compositions described herein are administered in combination with PARP inhibitors.

Pharmaceutical Compositions

In some embodiments, the present invention provides pharmaceutical compositions comprising one or more antisense agents. In some embodiments, pharmaceutical compositions comprise a suitable pharmaceutically acceptable diluent or carrier. In some embodiments, pharmaceutical compositions comprise a sterile saline solution and one or more antisense agents. In some embodiments, pharmaceutical compositions consist of a sterile saline solution and one or more antisense agents. In some embodiments, a sterile saline is pharmaceutical grade saline. In some embodiments, pharmaceutical compositions comprise sterile water and one or more antisense agents. In some embodiments, pharmaceutical compositions consist of sterile water and one or more antisense agents. In some embodiments, a sterile saline is pharmaceutical grade water. In some embodiments, pharmaceutical compositions comprise phosphate-buffered saline (PBS) and one or more antisense agents. In some embodiments, pharmaceutical compositions consist of sterile phosphate-buffered saline (PBS) and one or more antisense agents. In some embodiments, a sterile saline is pharmaceutical grade PBS.

In some embodiments, antisense agents may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions comprising antisense agents as disclosed herein encompass any pharmaceutically acceptable salts, esters, or salts of such esters. In some embodiments, pharmaceutical compositions comprising antisense agents comprise one or more oligonucleotides which, upon administration to an animal, including a human, is capable of providing (directly or indirectly) the biologically active metabolite or residue thereof. Accordingly, for example, the disclosure is also drawn to pharmaceutically acceptable salts of antisense agents, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an oligomeric compound which are cleaved by endogenous nucleases within the body, to form the active antisense oligomeric agent.

Lipid moieties have been used in nucleic acid therapies in a variety of methods. In certain such methods, a nucleic acid is introduced into preformed liposomes or lipoplexes made of mixtures of cationic lipids and neutral lipids. In some methods, DNA complexes with mono- or poly-cationic lipids are formed without the presence of a neutral lipid. In some embodiments, a lipid moiety is selected to increase distribution of a pharmaceutical agent to a particular cell or tissue. In some embodiments, a lipid moiety is selected to increase distribution of a pharmaceutical agent to CNS tissue. In some embodiments, a lipid moiety is selected to increase distribution of a pharmaceutical agent to PNS tissue.

In some embodiments, pharmaceutical compositions provided herein comprise one or more modified oligonucleotides and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In some embodiments, a pharmaceutical composition provided herein comprises a delivery system. Examples of delivery systems include, but are not limited to, liposomes and emulsions. Certain delivery systems are useful for preparing certain pharmaceutical compositions including those comprising hydrophobic compounds. In some embodiments, certain organic solvents such as dimethylsulfoxide are used.

In some embodiments, a pharmaceutical composition provided herein comprises one or more tissue-specific delivery molecules designed to deliver the one or more pharmaceutical agents of the present invention to specific tissues or cell types. For example, in some embodiments, pharmaceutical compositions include liposomes coated with a tissue-specific antibody.

In some embodiments, a pharmaceutical composition provided herein comprises a co-solvent system. Certain of such co-solvent systems comprise, for example, benzyl alcohol, a nonpolar surfactant, a water-miscible organic polymer, and an aqueous phase. In some embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In some embodiments, a pharmaceutical composition provided herein is prepared for oral administration. In some embodiments, pharmaceutical compositions are prepared for buccal administration. In some embodiments, a pharmaceutical composition is prepared for administration by injection (e.g., intravenous, subcutaneous, intramuscular, etc.). In certain of such embodiments, a pharmaceutical composition comprises a carrier and is formulated in aqueous solution, such as water or physiologically compatible buffers such as Hanks's solution, Ringer's solution, or physiological saline buffer. In some embodiments, other ingredients are included (e.g., ingredients that aid in solubility or serve as preservatives). In some embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may contain substances that increase the viscosity of the suspension, such as sodium carboxymethyl cellulose, sorbitol, or dextran. Optionally, such suspensions may also contain suitable stabilizers or agents that increase the solubility of the pharmaceutical agents to allow for the preparation of highly concentrated solutions. In some embodiments, a pharmaceutical composition is prepared for transmucosal administration. In certain of such embodiments penetrants appropriate to the barrier to be permeated are used in the formulation. Such penetrants are generally known in the art.

In some embodiments, a pharmaceutical composition provided herein comprises an oligonucleotide in a therapeutically effective amount. In some embodiments, the therapeutically effective amount is sufficient to prevent, alleviate or ameliorate symptoms of a disease or to prolong the survival of the subject being treated. Determination of a therapeutically effective amount is well within the capability of those skilled in the art.

In some embodiments, one or more modified oligonucleotides provided herein are formulated as a prodrug. In some embodiments, upon in vivo administration, a prodrug is chemically converted to a biologically, pharmaceutically or therapeutically more active form of an oligonucleotide. In some embodiments, prodrugs are useful because they are easier to administer than the corresponding active form. For example, in certain instances, a prodrug may be more bioavailable (e.g., through oral administration) than is the corresponding active form. In some instances, a prodrug may have improved solubility compared to the corresponding active form. In some embodiments, prodrugs are less water soluble than the corresponding active form. In some instances, such prodrugs possess superior transmittal across cell membranes, where water solubility is detrimental to mobility. In some embodiments, a prodrug is an ester. In certain such embodiments, the ester is metabolically hydrolyzed to carboxylic acid upon administration. In certain instances, the carboxylic acid containing compound is the corresponding active form. In certain embodiments, a prodrug comprises a short peptide (polyaminoacid) bound to an acid group. In certain of such embodiments, the peptide is cleaved upon administration to form the corresponding active form.

In some embodiments, the present invention provides compositions and methods for reducing the amount or activity of a target nucleic acid in a cell. In some embodiments, the cell is in an animal. In some embodiments, an animal is a mammal. In some embodiments, an animal is a rodent. In some embodiments, an animal is a primate. In some embodiments, an animal is a non-human primate. In some embodiments, an animal is a human.

In some embodiments, the present invention provides methods of administering a pharmaceutical composition comprising an oligomeric agent of the present invention to an animal. Suitable administration routes include, but are not limited to, oral, rectal, transmucosal, intestinal, enteral, topical, suppository, through inhalation, intrathecal, intracerebroventricular, intraperitoneal, intranasal, intraocular, intratumoral, intracisternal and parenteral (e.g., intravenous, intramuscular, intramedullary, and subcutaneous). In some embodiments, pharmaceutical intrathecals are administered to achieve local rather than systemic exposures. For example, pharmaceutical compositions may be injected directly in the area of desired effect (e.g., into the eyes, ears).

In some embodiments, a pharmaceutical composition is administered to an animal having at least one symptom associated with a neurodegenerative disease or disorder. In some embodiments, such administration results in amelioration of at least one symptom. In some embodiments, administration of a pharmaceutical composition to an animal results in a decrease of SARM1 mRNA in a cell of the animal. In some embodiments, such administration results in a decrease in SARM1 protein.

Exemplary Embodiments

1. An antisense oligonucleotide comprising a sequence having at least 80% identity to a sequence selected from a group consisting of SEQ ID NO: 3-26.
2. The antisense oligonucleotide of embodiment 1, comprising a sequence having at least 85% identity to a sequence selected from a group consisting of SEQ ID NO: 3-26.
3. The antisense oligonucleotide of embodiment 1 or embodiment 2, comprising a sequence having at least 90% identity to a sequence selected from a group consisting of SEQ ID NO: 3-26.
4. The antisense oligonucleotide of any one of embodiments 1-3, comprising a sequence selected from a group consisting of SEQ ID NO: 3-26.
5. An antisense oligonucleotide comprising a sequence selected from a group consisting of SEQ ID NO: 3-2081.
6. The antisense oligonucleotide of any one of embodiments 1-5, wherein the antisense oligonucleotide comprises one or more modifications.
7. The antisense oligonucleotide of embodiment 6, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.
8. A pharmaceutical composition comprising an antisense oligonucleotide of any one of the previous embodiments.
9. The pharmaceutical composition of embodiment 8, wherein the pharmaceutical composition comprises a pharmaceutically acceptable carrier.
10. A method for treating and/or preventing axonal degeneration in a subject, comprising: administering to the subject an antisense oligonucleotide is complementary to a target region of a nucleic acid encoding Sterile Alpha and TIR motif-containing 1 (SARM1).
11. A method comprising administering to a subject at risk of developing a neurodegenerative disease or disorder an antisense oligonucleotide that is complementary to a target region of a nucleic acid encoding SARM1.
12. The method of embodiment 10 or embodiment 11, wherein the target nucleic acid encoding SARM1 is a SARM1 mRNA.
13. The method of any one of embodiments 10-12, wherein the antisense oligonucleotide comprises a sequence having at least 80% identity to a sequence selected from a group consisting of SEQ ID NO: 3-26.

14. The method of any one of embodiments 10-13, wherein the antisense oligonucleotide comprises a sequence having at least 85% identity to a sequence selected from a group consisting of SEQ ID NO: 3-26.

15. The method of any one of embodiments 10-14, wherein the antisense oligonucleotide comprises a sequence having at least 90% identity to a sequence selected from a group consisting of SEQ ID NO: 3-26.

16. The method of any one of embodiments 10-15, wherein the antisense oligonucleotide comprises a sequence selected from a group consisting of SEQ ID NO: 3-26.

17. The method of any one of embodiments 10-12, wherein the antisense oligonucleotide comprises a sequence selected from a group consisting of SEQ ID NO: 3-2081.

18. The method of any one of embodiments 10-17, wherein the antisense oligonucleotide comprises one or more modifications.

19. The method of embodiment 18, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

20. The method of any one of embodiments 10-19, wherein administering the antisense oligonucleotide decreases levels of SARM1 mRNA in the subject.

21. The method of any one of embodiments 10-19, wherein administering the antisense oligonucleotide decreases levels of SARM1 protein in the subject.

22. The method of any one of embodiments 11-21, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

23. The method of any of embodiments 11-21, wherein the neurodegenerative disease or disorder comprises a chronic disease or disorder of the PNS.

24. The method of embodiment 23, wherein the chronic disease or disorder of the PNS comprises a systemic disorder, a pain disorder, or a metabolic disease or disorder.

25. The method of embodiment 23, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

26. The method of embodiment 24, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

27. The method of embodiment 24, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

28. The method of embodiment 24, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

29. The method of any one of embodiments 11-22, the neurodegenerative disease or disorder comprises an acute disease or disorder of the peripheral nervous system.

30. The method of embodiment 29, wherein the acute disease or disorder of the PNS is the result of a mechanical injury, thermal injury, or injury from a chemical agent or chemotherapy.

31. The method of embodiment 30, wherein the mechanical injury comprises a compression or entrapment injury or a pressure injury.

32. The method of embodiment 31, wherein the compression or entrapment injury comprises carpal tunnel syndrome, direct trauma, a penetrating injury, a contusion, a fracture or a dislocated bone.

33. The method of embodiment 31, wherein the pressure injury comprises pressure involving superficial nerves, pressure from a tumor or increased intraocular pressure.

34. The method of embodiment 30, wherein the chemical agent or chemotherapy comprises a cytotoxic anticancer agent, thalidomide, an epothilone, a taxane, a vinca alkaloid, a proteasome inhibitor, a platinum-based drug or an auristatin.

35. The method of embodiment 34, wherein the epothilone is ixabepilone.

36. The method of embodiment 34, wherein the taxane is paclitaxel or docetaxel.

37. The method of embodiment 34, wherein the vinca alkaloid is vinblastine, vinorelbine, vincristine, or vindesine.

38. The method of embodiment 34, wherein the proteasome inhibitor is bortezomib.

39. The method of embodiment 34, wherein the platinum-based drug is cisplatin, oxaliplatin, or carboplatin.

40. The method of embodiment 34, wherein the auristatin is conjugated monomethyl auristatin E.

41. The method of any one of embodiments 11-22, wherein the neurodegenerative disease or disorder comprises a chronic disease or disorder of the CNS.

42. The method of embodiment 41, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornz-weig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

43. The method of embodiment 41, wherein the chronic disease or disorder of the CNS comprises an optic nerve disorder, a traumatic CNS injury, or a metabolic disease or disorder.

44. The method of embodiment 43, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

45. The method of embodiment 43, wherein the traumatic CNS injury comprises a traumatic brain injury (TBI), a spinal cord injury, traumatic axonal injury or chronic traumatic encephalopathy (CTE).

46. The method of embodiment 43, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

47. The method of any one of embodiments 11-22, wherein the neurodegenerative disease or disorder comprises an acute disease or disorder of the CNS.

48. The method of embodiment 47, wherein the acute disease or disorder of the CNS comprises an ischemia, a traumatic CNS injury, injury from a chemical agent, thermal injury, or viral encephalitis.

49. The method of embodiment 48, wherein the ischemia comprises cerebral ischemia, hypoxic demyelination, ischemic demyelination, ischemic optic neuropathy, or non-arteritic anterior ischemic optic neuropathy.

50. The method of embodiment 48, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

51. The method of embodiment 48, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

52. The method of any one of embodiments 11-22, wherein the neurodegenerative disease or disorder results from blood clotting issues, inflammation, obesity, aging, stress, cancer, or diabetes.

53. The method of any one of embodiments 10-52, wherein the subject is a human.

54. The method of any one of embodiments 10-53, wherein the subject is a patient with one or more risk factors for developing a condition involving axonal degeneration.

55. The method of embodiments 54, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

56. The method of embodiment 55, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

57. The method of embodiment 55, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

58. The method of embodiment 55, wherein the one or more biomarkers of neurodegeneration comprises:
concentration of neurofilament light chain protein (NF-L) in one or more of: a cerebrospinal fluid (CSF) sample, a blood sample, and a plasma sample from the subject;
concentration of neurofilament heavy chain protein (NF-H) in one or more of: a cerebrospinal fluid (CSF) sample, a blood sample, and a plasma sample from the subject;
concentration of Ubiquitin C-terminal Hydrolase L1 (UCH-L1) in one or more of: a cerebrospinal fluid (CSF) sample, a blood sample, and a plasma sample from the subject;
concentration of alpha-synuclein in one or more of: a cerebrospinal fluid (CSF) sample, a blood sample, and a plasma sample from the subject;
constitutive NAD+ levels in neurons and/or axons of the subject;
constitutive cADPR levels in neurons and/or axons of the subject;
levels of albumin, amyloid-β (Aβ)38, Aβ40, Aβ42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)α, sAPPβ, soluble triggering receptor expressed on myeloid cells (sTREM) 2, phospho-tau, or total-tau in one or more of: a cerebrospinal fluid biopsy sample from the subject; and
levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

59. An antisense oligonucleotide comprising a sequence having at least 80% identity to a sequence selected from a group consisting of SEQ ID NO: 3-21, 23-26, 38 and 39.

60. The antisense oligonucleotide of embodiment 59, comprising a sequence having at least 85% identity to a sequence selected from a group consisting of SEQ ID NO: 3-21, 23-26, 38 and 39.

61. The antisense oligonucleotide of embodiment 59 or embodiment 60, comprising a sequence having at least 90% identity to a sequence selected from a group consisting of SEQ ID NO: 3-21, 23-26, 38 and 39.

62. The antisense oligonucleotide of any one of embodiments 59-61, comprising a sequence selected from a group consisting of SEQ ID NO: 3-21, 23-26, 38 and 39.

63. An antisense oligonucleotide comprising a sequence having at least 80% identity to a sequence selected from a group consisting of SEQ ID NO: 8, 9, 13, 22, 38, and 549.

64. The antisense oligonucleotide of embodiment 63, comprising a sequence having at least 85% identity to a sequence selected from a group consisting of 8, 9, 13, 22, 38, and 549.

65. The antisense oligonucleotide of embodiment 63 or embodiment 64, comprising a sequence having at least 90% identity to a sequence selected from a group consisting of 8, 9, 13, 22, 38, and 549.

66. The antisense oligonucleotide of any one of embodiments 63-65, comprising a sequence selected from a group consisting of SEQ ID NO: 8, 9, 13, 22, 38, and 549.

67. An antisense oligonucleotide comprising a sequence selected from a group consisting of SEQ ID NO: 3-2412.

68. The antisense oligonucleotide of any one of embodiments 59-66, wherein the antisense oligonucleotide comprises one or more modifications.

69. The antisense oligonucleotide of embodiment 68, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

70. A pharmaceutical composition comprising an antisense oligonucleotide of any one of the previous embodiments.

71. A pharmaceutical composition comprising an antisense oligonucleotide of any one of embodiments 59-70.

72. The pharmaceutical composition of embodiment 70 or 71, wherein the pharmaceutical composition comprises a pharmaceutically acceptable carrier.

73. A method for treating and/or preventing axonal degeneration in a subject, comprising: administering to the subject an antisense oligonucleotide that is complementary to a target region of a nucleic acid encoding Sterile Alpha and TIR motif-containing 1 (SARM1).

74. A method comprising administering to a subject at risk of developing a neurodegenerative disease or disorder an antisense oligonucleotide that is complementary to a target region of a nucleic acid encoding SARM1.

75. The method of embodiment 73 or embodiment 74, wherein the target nucleic acid encoding SARM1 is a SARM1 mRNA.

76. The method of any one of embodiments 73-75, wherein the antisense oligonucleotide comprises a sequence having at least 80% identity to a sequence selected from a group consisting of SEQ ID NO: 3-21, 23-26, 38 and 39.

77. The method of any one of embodiments 73-76, wherein the antisense oligonucleotide comprises a sequence having at least 85% identity to a sequence selected from a group consisting of SEQ ID NO: 3-21, 23-26, 38 and 39.

78. The method of any one of embodiments 73-77, wherein the antisense oligonucleotide comprises a sequence having at least 90% identity to a sequence selected from a group consisting of SEQ ID NO: 3-21, 23-26, 38 and 39.

79. The method of any one of embodiments 73-78, wherein the antisense oligonucleotide comprises a sequence selected from a group consisting of SEQ ID NO: 3-21, 23-26, 38 and 39.

80. The method of any one of embodiments 73-75, wherein the antisense oligonucleotide comprises a sequence having at least 80% identity to a sequence selected from a group consisting of SEQ ID NO: 8, 9, 13, 22, 38, and 549.

81. The method of any one of embodiments 73-75, and 80, wherein the antisense oligonucleotide comprises a sequence having at least 85% identity to a sequence selected from a group consisting of SEQ ID NO: 8, 9, 13, 22, 38, and 549.

82. The method of any one of embodiments 73-75, and 80-81, wherein the antisense oligonucleotide comprises a sequence having at least 90% identity to a sequence selected from a group consisting of SEQ ID NO: 8, 9, 13, 22, 38, and 549.

83. The method of any one of embodiments 73-75, and 80-82, wherein the antisense oligonucleotide comprises a sequence selected from a group consisting of SEQ ID NO: 8, 9, 13, 22, 38, and 549.

84. The method of any one of embodiments 73-75, wherein the antisense oligonucleotide comprises a sequence selected from a group consisting of SEQ ID NO: 3-2412.

85. The method of any one of embodiments 73-84, wherein the antisense oligonucleotide comprises one or more modifications.

86. The method of embodiment 85, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

87. The method of any one of embodiments 73-86, wherein administering the antisense oligonucleotide decreases levels of SARM1 mRNA in the subject.

88. The method of any one of embodiments 73-86, wherein administering the antisense oligonucleotide decreases levels of SARM1 protein in the subject.

89. The method of any one of embodiments 74-88, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

90. The method of any of embodiments 74-88, wherein the neurodegenerative disease or disorder comprises a chronic disease or disorder of the PNS.

91. The method of embodiment 90, wherein the chronic disease or disorder of the PNS comprises a systemic disorder, a pain disorder, or a metabolic disease or disorder.

92. The method of embodiment 90, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

93. The method of embodiment 91, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

94. The method of embodiment 91, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

95. The method of embodiment 91, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

96. The method of any one of embodiments 74-89, the neurodegenerative disease or disorder comprises an acute disease or disorder of the peripheral nervous system.

97. The method of embodiment 96, wherein the acute disease or disorder of the PNS is the result of a mechanical injury, thermal injury, or injury from a chemical agent or chemotherapy.

98. The method of embodiment 97, wherein the mechanical injury comprises a compression or entrapment injury or a pressure injury.

99. The method of embodiment 98, wherein the compression or entrapment injury comprises carpal tunnel syndrome, direct trauma, a penetrating injury, a contusion, a fracture or a dislocated bone.

100. The method of embodiment 98, wherein the pressure injury comprises pressure involving superficial nerves, pressure from a tumor or increased intraocular pressure.

101. The method of embodiment 97, wherein the chemical agent or chemotherapy comprises a cytotoxic anti-cancer agent, thalidomide, an epothilone, a taxane, a vinca alkaloid, a proteasome inhibitor, a platinum-based drug or an auristatin.

102. The method of embodiment 101, wherein the epothilone is ixabepilone.

103. The method of embodiment 101, wherein the taxane is paclitaxel or docetaxel.

104. The method of embodiment 101, wherein the vinca alkaloid is vinblastine, vinorelbine, vincristine, or vindesine.

105. The method of embodiment 101, wherein the proteasome inhibitor is bortezomib.

106. The method of embodiment 101, wherein the platinum-based drug is cisplatin, oxaliplatin, or carboplatin.

107. The method of embodiment 101, wherein the auristatin is conjugated monomethyl auristatin E.

108. The method of any one of embodiments 74-89, wherein the neurodegenerative disease or disorder comprises a chronic disease or disorder of the CNS.

109. The method of embodiment 108, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

110. The method of embodiment 108, wherein the chronic disease or disorder of the CNS comprises an optic nerve disorder, a traumatic CNS injury, or a metabolic disease or disorder.

111. The method of embodiment 110, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

112. The method of embodiment 110, wherein the traumatic CNS injury comprises a traumatic brain injury (TBI), a spinal cord injury, traumatic axonal injury or chronic traumatic encephalopathy (CTE).

113. The method of embodiment 110, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

114. The method of any one of embodiments 74-89, wherein the neurodegenerative disease or disorder comprises an acute disease or disorder of the CNS.

115. The method of embodiment 114, wherein the acute disease or disorder of the CNS comprises an ischemia, a traumatic CNS injury, injury from a chemical agent, thermal injury, or viral encephalitis.

116. The method of embodiment 115, wherein the ischemia comprises cerebral ischemia, hypoxic demyelination, ischemic demyelination, ischemic optic neuropathy, or non-arteritic anterior ischemic optic neuropathy.

117. The method of embodiment 115, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

118. The method of embodiment 115, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

119. The method of any one of embodiments 74-89, wherein the neurodegenerative disease or disorder results from blood clotting issues, inflammation, obesity, aging, stress, cancer, or diabetes.

120. The method of any one of embodiments 73-119, wherein the subject is a human.

121. The method of any one of embodiments 73-120, wherein the subject is a patient with one or more risk factors for developing a condition involving axonal degeneration.

122. The method of embodiment 121, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

123. The method of embodiment 122, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

124. The method of embodiment 122, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

125. The method of embodiment 122, wherein the one or more biomarkers of neurodegeneration comprises:

concentration of neurofilament light chain protein (NF-L) in one or more of: a cerebrospinal fluid (CSF) sample, a blood sample, and a plasma sample from the subject;

concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-β (Aβ)38, Aβ40, Aβ42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)α, sAPPβ, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

126. An antisense oligonucleotide selected from Table 3, for use in the manufacture of a medicament.

127. An antisense oligonucleotide selected from Table 3, for use in treatment of a disease, disorder or injury.

128. The antisense oligonucleotide of embodiment 127, wherein the disease, disorder or injury comprises inherited neuropathies, Charcot-Marie-Tooth disease, hereditary sensory and autonomic neuropathy (HSAN), chronic inflammatory demyelinating polyneuropathy (CIDP), idiopathic neuropathies, other peripheral neuropathies, diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, polyarteritis nodosa, chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, diabetes, diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, a mitochondrial disorder, carpal tunnel syndrome, direct trauma, a penetrating injury, a contusion, a fracture, a dislocated bone, pressure involving superficial nerves, pressure from a tumor, increased intraocular pressure, injury from a chemical agent or chemo-therapy, Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leuko-encephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, spinal cord injury, an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, exposure to cyanide, a traumatic brain injury (TBI), a spinal cord injury, traumatic axonal injury, chronic traumatic encephalopathy (CTE), diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, mitochondrial disorders, cerebral ischemia, hypoxic demyelination, ischemic demyelination, ischemic optic neuropathy, or non-arteritic anterior ischemic optic neuropathy, a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, damage from a force which causes axons to deform, stretch, crush or sheer, enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

129. An antisense oligonucleotide comprising a sequence having at least 80% identity to SEQ ID NO: 8.

130. The antisense oligonucleotide of embodiment 129, comprising a sequence having at least 85% identity to SEQ ID NO: 8.

131. The antisense oligonucleotide of embodiment 129 or embodiment 130, comprising a sequence having at least 90% identity to SEQ ID NO: 8.

132. The antisense oligonucleotide of any one of embodiments 129-131, comprising SEQ ID NO: 8.

133. The antisense oligonucleotide of any one of embodiments 129-132, wherein the antisense oligonucleotide comprises one or more modifications.

134. The antisense oligonucleotide of embodiment 133, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

135. A pharmaceutical composition comprising an antisense oligonucleotide of any one of embodiments 129-134.

136. The pharmaceutical composition of embodiment 135, wherein the pharmaceutical composition comprises a pharmaceutically acceptable carrier.

137. An antisense oligonucleotide comprising a sequence having at least 80% identity to SEQ ID NO: 9.

138. The antisense oligonucleotide of embodiment 137, comprising a sequence having at least 85% identity to SEQ ID NO: 9.

139. The antisense oligonucleotide of embodiment 137 or embodiment 138, comprising a sequence having at least 90% identity to SEQ ID NO: 9.

140. The antisense oligonucleotide of any one of embodiments 137-139, comprising SEQ ID NO: 9.

141. The antisense oligonucleotide of any one of embodiments 137-140, wherein the antisense oligonucleotide comprises one or more modifications.

142. The antisense oligonucleotide of embodiment 141, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

143. A pharmaceutical composition comprising an antisense oligonucleotide of any one of embodiments 137-142.

144. The pharmaceutical composition of embodiment 143, wherein the pharmaceutical composition comprises a pharmaceutically acceptable carrier.

145. An antisense oligonucleotide comprising a sequence having at least 80% identity to SEQ ID NO: 13.

146. The antisense oligonucleotide of embodiment 145, comprising a sequence having at least 85% identity to SEQ ID NO: 13.

147. The antisense oligonucleotide of embodiment 145 or embodiment 146, comprising a sequence having at least 90% identity to SEQ ID NO: 13.

148. The antisense oligonucleotide of any one of embodiments 145-147, comprising SEQ ID NO: 13.

149. The antisense oligonucleotide of any one of embodiments 145-148, wherein the antisense oligonucleotide comprises one or more modifications.

150. The antisense oligonucleotide of embodiment 149, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

151. A pharmaceutical composition comprising an antisense oligonucleotide of any one of embodiments 145-150.

152. The pharmaceutical composition of embodiment 151, wherein the pharmaceutical composition comprises a pharmaceutically acceptable carrier.

153. An antisense oligonucleotide comprising a sequence having at least 80% identity to SEQ ID NO: 22.

154. The antisense oligonucleotide of embodiment 153, comprising a sequence having at least 85% identity to SEQ ID NO: 22.

155. The antisense oligonucleotide of embodiment 153 or embodiment 154, comprising a sequence having at least 90% identity to SEQ ID NO: 22.

156. The antisense oligonucleotide of any one of embodiments 153-155, comprising SEQ ID NO: 22.

157. The antisense oligonucleotide of any one of embodiments 153-156, wherein the antisense oligonucleotide comprises one or more modifications.

158. The antisense oligonucleotide of embodiment 157, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

159. A pharmaceutical composition comprising an antisense oligonucleotide of any one of embodiments 153-158.

160. The pharmaceutical composition of embodiment 159, wherein the pharmaceutical composition comprises a pharmaceutically acceptable carrier.

161. An antisense oligonucleotide comprising a sequence having at least 80% identity to SEQ ID NO: 38.

162. The antisense oligonucleotide of embodiment 161, comprising a sequence having at least 85% identity to SEQ ID NO: 38.

163. The antisense oligonucleotide of embodiment 161 or embodiment 162, comprising a sequence having at least 90% identity to SEQ ID NO: 38.

164. The antisense oligonucleotide of any one of embodiments 161-163, comprising SEQ ID NO: 38.

165. The antisense oligonucleotide of any one of embodiments 161-164, wherein the antisense oligonucleotide comprises one or more modifications.

166. The antisense oligonucleotide of embodiment 165, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

167. A pharmaceutical composition comprising an antisense oligonucleotide of any one of embodiments 161-166.

168. The pharmaceutical composition of embodiment 167, wherein the pharmaceutical composition comprises a pharmaceutically acceptable carrier.

169. An antisense oligonucleotide comprising a sequence having at least 80% identity to SEQ ID NO: 549.

170. The antisense oligonucleotide of embodiment 169, comprising a sequence having at least 85% identity to SEQ ID NO: 549.

171. The antisense oligonucleotide of embodiment 169 or embodiment 170, comprising a sequence having at least 90% identity to SEQ ID NO: 549.

172. The antisense oligonucleotide of any one of embodiments 169-171, comprising SEQ ID NO: 549.

173. The antisense oligonucleotide of any one of embodiments 169-172, wherein the antisense oligonucleotide comprises one or more modifications.

174. The antisense oligonucleotide of embodiment 173, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

175. A pharmaceutical composition comprising an antisense oligonucleotide of any one of embodiments 169-174.

176. The pharmaceutical composition of embodiment 175, wherein the pharmaceutical composition comprises a pharmaceutically acceptable carrier.

177. A method for treating and/or preventing axonal degeneration in a subject, comprising: administering to the subject an antisense oligonucleotide that is complementary to a target region of a nucleic acid encoding Sterile Alpha and TIR motif-containing 1 (SARM1), wherein the antisense oligonucleotide comprises a sequence having at least 80% identity SEQ ID NO: 8.

178. The method of embodiment 177, wherein the antisense oligonucleotide comprises a sequence having at least 85% identity to SEQ ID NO: 8.

179. The method of embodiment 177 or embodiment 178, wherein the antisense oligonucleotide comprises a sequence having at least 90% identity to SEQ ID NO: 8.

180. The method of any one of embodiments 177-179, wherein the antisense oligonucleotide comprises SEQ ID NO: 8.

181. A method comprising administering to a subject at risk of developing a neurodegenerative disease or disorder an antisense oligonucleotide that is complementary to a target region of a nucleic acid encoding SARM1, wherein the antisense oligonucleotide comprises a sequence having at least 80% identity SEQ ID NO: 8.

182. The method of embodiment 181, wherein the antisense oligonucleotide comprises a sequence having at least 85% identity to SEQ ID NO: 8.

183. The method of embodiment 181 or embodiment 182, wherein the antisense oligonucleotide comprises a sequence having at least 90% identity to SEQ ID NO: 8.

184. The method of any one of embodiments 181-183, wherein the antisense oligonucleotide comprises SEQ ID NO: 8.

185. The method of any one of embodiments 177-184, wherein the target nucleic acid encoding SARM1 is a SARM1 mRNA.

186. The method of any one of embodiments 177-185, wherein the antisense oligonucleotide comprises one or more modifications.

187. The method of embodiment 186, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

188. The method of any one of embodiments 177-187, wherein administering the antisense oligonucleotide decreases levels of SARM1 mRNA in the subject.

189. The method of any one of embodiments 177-187, wherein administering the antisense oligonucleotide decreases levels of SARM1 protein in the subject.

190. The method of any one of embodiments 181-189, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

191. The method of any of embodiments 181-189, wherein the neurodegenerative disease or disorder comprises a chronic disease or disorder of the PNS.

192. The method of embodiment 191, wherein the chronic disease or disorder of the PNS comprises a systemic disorder, a pain disorder, or a metabolic disease or disorder.

193. The method of embodiment 191, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

194. The method of embodiment 192, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

195. The method of embodiment 192, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

196. The method of embodiment 192, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/ glycolipid metabolism, a nutritional deficiency, a vitamin deficiency, or a mitochondrial disorder.

197. The method of any one of embodiments 181-190, the neurodegenerative disease or disorder comprises an acute disease or disorder of the peripheral nervous system.

198. The method of embodiment 197, wherein the acute disease or disorder of the PNS is the result of a mechanical injury, thermal injury, or injury from a chemical agent or chemotherapy.

199. The method of embodiment 198, wherein the mechanical injury comprises a compression or entrapment injury or a pressure injury.

200. The method of embodiment 199, wherein the compression or entrapment injury comprises carpal tunnel syndrome, direct trauma, a penetrating injury, a contusion, a fracture or a dislocated bone.

201. The method of embodiment 199, wherein the pressure injury comprises pressure involving superficial nerves, pressure from a tumor or increased intraocular pressure.

202. The method of embodiment 198, wherein the chemical agent or chemotherapy comprises a cytotoxic anticancer agent, thalidomide, an epothilone, a taxane, a vinca alkaloid, a proteasome inhibitor, a platinum-based drug or an auristatin.

203. The method of embodiment 202, wherein the epothilone is ixabepilone.

204. The method of embodiment 202, wherein the taxane is paclitaxel or docetaxel.

205. The method of embodiment 202, wherein the vinca alkaloid is vinblastine, vinorelbine, vincristine, or vindesine.

206. The method of embodiment 202, wherein the proteasome inhibitor is bortezomib.

207. The method of embodiment 202, wherein the platinum-based drug is cisplatin, oxaliplatin, or carboplatin.

208. The method of embodiment 202, wherein the auristatin is conjugated monomethyl auristatin E.

209. The method of any one of embodiments 181-190, wherein the neurodegenerative disease or disorder comprises a chronic disease or disorder of the CNS.

210. The method of embodiment 209, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

211. The method of embodiment 209, wherein the chronic disease or disorder of the CNS comprises an optic nerve disorder, a traumatic CNS injury, or a metabolic disease or disorder.

212. The method of embodiment 211, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

213. The method of embodiment 211, wherein the traumatic CNS injury comprises a traumatic brain injury (TBI), a spinal cord injury, traumatic axonal injury or chronic traumatic encephalopathy (CTE).

214. The method of embodiment 211, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

215. The method of any one of embodiments 181-190, wherein the neurodegenerative disease or disorder comprises an acute disease or disorder of the CNS.

216. The method of embodiment 215, wherein the acute disease or disorder of the CNS comprises an ischemia, a traumatic CNS injury, injury from a chemical agent, thermal injury, or viral encephalitis.

217. The method of embodiment 216, wherein the ischemia comprises cerebral ischemia, hypoxic demyelination, ischemic demyelination, ischemic optic neuropathy, or non-arteritic anterior ischemic optic neuropathy.

218. The method of embodiment 216, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

219. The method of embodiment 216, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

220. The method of any one of embodiments 181-190, wherein the neurodegenerative disease or disorder results from blood clotting issues, inflammation, obesity, aging, stress, cancer, or diabetes.

221. The method of any one of embodiments 177-220, wherein the subject is a human.

222. The method of any one of embodiments 177-221, wherein the subject is a patient with one or more risk factors for developing a condition involving axonal degeneration.

223. The method of embodiments 222, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

224. The method of embodiment 223, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

225. The method of embodiment 223, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

226. The method of embodiment 223, wherein the one or more biomarkers of neurodegeneration comprises:

concentration of neurofilament light chain protein (NF-L) in one or more of: a cerebrospinal fluid (CSF) sample, a blood sample, and a plasma sample from the subject;

concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-$\beta$ (A$\beta$)38, A$\beta$40, A$\beta$42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)$\alpha$, sAPP$\beta$, soluble triggering receptor expressed on myeloid cells (sTREM) 2, phospho-tau, or total-tau in one or more of: a cerebrospinal fluid biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

227. A method for treating and/or preventing axonal degeneration in a subject, comprising:

administering to the subject an antisense oligonucleotide that is complementary to a target region of a nucleic acid encoding Sterile Alpha and TIR motif-containing 1 (SARM1), wherein the antisense oligonucleotide comprises a sequence having at least 80% identity SEQ ID NO: 9.

228. The method of embodiment 227, wherein the antisense oligonucleotide comprises a sequence having at least 85% identity to SEQ ID NO: 9.

229. The method of embodiment 227 or embodiment 228, wherein the antisense oligonucleotide comprises a sequence having at least 90% identity to SEQ ID NO: 9.

230. The method of any one of embodiments 227-229, wherein the antisense oligonucleotide comprises SEQ ID NO: 9.

231. A method comprising administering to a subject at risk of developing a neurodegenerative disease or disorder an antisense oligonucleotide that is complementary to a target region of a nucleic acid encoding SARM1, wherein the antisense oligonucleotide comprises a sequence having at least 80% identity SEQ ID NO: 9.

232. The method of embodiment 231, wherein the antisense oligonucleotide comprises a sequence having at least 85% identity to SEQ ID NO: 9.

233. The method of embodiment 231 or embodiment 232, wherein the antisense oligonucleotide comprises a sequence having at least 90% identity to SEQ ID NO: 9.

234. The method of any one of embodiments 231-233, wherein the antisense oligonucleotide comprises SEQ ID NO: 9.

235. The method of any one of embodiments 227-234, wherein the target nucleic acid encoding SARM1 is a SARM1 mRNA.

236. The method of any one of embodiments 227-235, wherein the antisense oligonucleotide comprises one or more modifications.

237. The method of embodiment 236, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

238. The method of any one of embodiments 227-237, wherein administering the antisense oligonucleotide decreases levels of SARM1 mRNA in the subject.

239. The method of any one of embodiments 227-237, wherein administering the antisense oligonucleotide decreases levels of SARM1 protein in the subject.

240. The method of any one of embodiments 231-239, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

241. The method of any of embodiments 231-239, wherein the neurodegenerative disease or disorder comprises a chronic disease or disorder of the PNS.

242. The method of embodiment 241, wherein the chronic disease or disorder of the PNS comprises a systemic disorder, a pain disorder, or a metabolic disease or disorder.

243. The method of embodiment 241, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

244. The method of embodiment 242, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

245. The method of embodiment 242, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

246. The method of embodiment 242, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

247. The method of any one of embodiments 231-240, the neurodegenerative disease or disorder comprises an acute disease or disorder of the peripheral nervous system.

248. The method of embodiment 247, wherein the acute disease or disorder of the PNS is the result of a mechanical injury, thermal injury, or injury from a chemical agent or chemotherapy.

249. The method of embodiment 248, wherein the mechanical injury comprises a compression or entrapment injury or a pressure injury.

250. The method of embodiment 249, wherein the compression or entrapment injury comprises carpal tunnel syndrome, direct trauma, a penetrating injury, a contusion, a fracture or a dislocated bone.

251. The method of embodiment 249, wherein the pressure injury comprises pressure involving superficial nerves, pressure from a tumor or increased intraocular pressure.

252. The method of embodiment 248, wherein the chemical agent or chemotherapy comprises a cytotoxic anticancer agent, thalidomide, an epothilone, a taxane, a vinca alkaloid, a proteasome inhibitor, a platinum-based drug or an auristatin.

253. The method of embodiment 252, wherein the epothilone is ixabepilone.

254. The method of embodiment 252, wherein the taxane is paclitaxel or docetaxel.

255. The method of embodiment 252, wherein the vinca alkaloid is vinblastine, vinorelbine, vincristine, or vindesine.

256. The method of embodiment 252, wherein the proteasome inhibitor is bortezomib.

257. The method of embodiment 252, wherein the platinum-based drug is cisplatin, oxaliplatin, or carboplatin.

258. The method of embodiment 252, wherein the auristatin is conjugated monomethyl auristatin E.

259. The method of any one of embodiments 231-240, wherein the neurodegenerative disease or disorder comprises a chronic disease or disorder of the CNS.

260. The method of embodiment 259, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

261. The method of embodiment 259, wherein the chronic disease or disorder of the CNS comprises an optic nerve disorder, a traumatic CNS injury, or a metabolic disease or disorder.

262. The method of embodiment 261, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

263. The method of embodiment 261, wherein the traumatic CNS injury comprises a traumatic brain injury (TBI), a spinal cord injury, traumatic axonal injury or chronic traumatic encephalopathy (CTE).

264. The method of embodiment 261, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

265. The method of any one of embodiments 231-240, wherein the neurodegenerative disease or disorder comprises an acute disease or disorder of the CNS.

266. The method of embodiment 215, wherein the acute disease or disorder of the CNS comprises an ischemia, a traumatic CNS injury, injury from a chemical agent, thermal injury, or viral encephalitis.

267. The method of embodiment 266, wherein the ischemia comprises cerebral ischemia, hypoxic demyelination, ischemic demyelination, ischemic optic neuropathy, or non-arteritic anterior ischemic optic neuropathy.

268. The method of embodiment 266, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

269. The method of embodiment 266, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

270. The method of any one of embodiments 231-240, wherein the neurodegenerative disease or disorder results from blood clotting issues, inflammation, obesity, aging, stress, cancer, or diabetes.

271. The method of any one of embodiments 227-270, wherein the subject is a human.

272. The method of any one of embodiments 227-271, wherein the subject is a patient with one or more risk factors for developing a condition involving axonal degeneration.

273. The method of embodiments 272, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

274. The method of embodiment 273, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a 275. The method of embodiment 273, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

276. The method of embodiment 273, wherein the one or more biomarkers of neurodegeneration comprises:

concentration of neurofilament light chain protein (NF-L) in one or more of: a cerebrospinal fluid (CSF) sample, a blood sample, and a plasma sample from the subject;

concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-$\beta$ (A$\beta$)38, A$\beta$40, A$\beta$42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)$\alpha$, sAPP$\beta$, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

277. A method for treating and/or preventing axonal degeneration in a subject, comprising: administering to the subject an antisense oligonucleotide that is complementary to a target region of a nucleic acid encoding Sterile Alpha and TIR motif-containing 1 (SARM1), wherein the antisense oligonucleotide comprises a sequence having at least 80% identity SEQ ID NO: 13.

278. The method of embodiment 277, wherein the antisense oligonucleotide comprises a sequence having at least 85% identity to SEQ ID NO: 13.

279. The method of embodiment 277 or embodiment 278, wherein the antisense oligonucleotide comprises a sequence having at least 90% identity to SEQ ID NO: 13.

280. The method of any one of embodiments 277-279, wherein the antisense oligonucleotide comprises SEQ ID NO: 13.

281. A method comprising administering to a subject at risk of developing a neurodegenerative disease or disorder an antisense oligonucleotide that is complementary to a target region of a nucleic acid encoding SARM1, wherein the antisense oligonucleotide comprises a sequence having at least 80% identity SEQ ID NO: 13.

282. The method of embodiment 281, wherein the antisense oligonucleotide comprises a sequence having at least 85% identity to SEQ ID NO: 13.

283. The method of embodiment 281 or embodiment 282, wherein the antisense oligonucleotide comprises a sequence having at least 90% identity to SEQ ID NO: 13.

284. The method of any one of embodiments 281-283, wherein the antisense oligonucleotide comprises SEQ ID NO: 13.

285. The method of any one of embodiments 277-284, wherein the target nucleic acid encoding SARM1 is a SARM1 mRNA.

286. The method of any one of embodiments 277-285, wherein the antisense oligonucleotide comprises one or more modifications.

287. The method of embodiment 286, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

288. The method of any one of embodiments 277-287, wherein administering the antisense oligonucleotide decreases levels of SARM1 mRNA in the subject.

289. The method of any one of embodiments 277-287, wherein administering the antisense oligonucleotide decreases levels of SARM1 protein in the subject.

290. The method of any one of embodiments 281-289, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

291. The method of any of embodiments 281-289, wherein the neurodegenerative disease or disorder comprises a chronic disease or disorder of the PNS.

292. The method of embodiment 291, wherein the chronic disease or disorder of the PNS comprises a systemic disorder, a pain disorder, or a metabolic disease or disorder.

293. The method of embodiment 291, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

294. The method of embodiment 292, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

295. The method of embodiment 292, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

296. The method of embodiment 292, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/ glycolipid metabolism, a nutritional deficiency, a vitamin deficiency, or a mitochondrial disorder.

297. The method of any one of embodiments 281-290, the neurodegenerative disease or disorder comprises an acute disease or disorder of the peripheral nervous system.

298. The method of embodiment 297, wherein the acute disease or disorder of the PNS is the result of a mechanical injury, thermal injury, or injury from a chemical agent or chemotherapy.

299. The method of embodiment 298, wherein the mechanical injury comprises a compression or entrapment injury or a pressure injury.

300. The method of embodiment 298, wherein the compression or entrapment injury comprises carpal tunnel syndrome, direct trauma, a penetrating injury, a contusion, a fracture or a dislocated bone.

301. The method of embodiment 298, wherein the pressure injury comprises pressure involving superficial nerves, pressure from a tumor or increased intraocular pressure.

302. The method of embodiment 298, wherein the chemical agent or chemotherapy comprises a cytotoxic anticancer agent, thalidomide, an epothilone, a taxane, a vinca alkaloid, a proteasome inhibitor, a platinum-based drug or an auristatin.

303. The method of embodiment 302, wherein the epothilone is ixabepilone.

304. The method of embodiment 302, wherein the taxane is paclitaxel or docetaxel.

305. The method of embodiment 302, wherein the vinca alkaloid is vinblastine, vinorelbine, vincristine, or vindesine.

306. The method of embodiment 302, wherein the proteasome inhibitor is bortezomib.

307. The method of embodiment 302, wherein the platinum-based drug is cisplatin, oxaliplatin, or carboplatin.

308. The method of embodiment 302, wherein the auristatin is conjugated monomethyl auristatin E.

309. The method of any one of embodiments 281-290, wherein the neurodegenerative disease or disorder comprises a chronic disease or disorder of the CNS.

310. The method of embodiment 309, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

311. The method of embodiment 309, wherein the chronic disease or disorder of the CNS comprises an optic nerve disorder, a traumatic CNS injury, or a metabolic disease or disorder.

312. The method of embodiment 311, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

313. The method of embodiment 311, wherein the traumatic CNS injury comprises a traumatic brain injury (TBI), a spinal cord injury, traumatic axonal injury or chronic traumatic encephalopathy (CTE).

314. The method of embodiment 311, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

315. The method of any one of embodiments 281-290, wherein the neurodegenerative disease or disorder comprises an acute disease or disorder of the CNS.

316. The method of embodiment 315, wherein the acute disease or disorder of the CNS comprises an ischemia, a traumatic CNS injury, injury from a chemical agent, thermal injury, or viral encephalitis.

317. The method of embodiment 316, wherein the ischemia comprises cerebral ischemia, hypoxic demyelination, ischemic demyelination, ischemic optic neuropathy, or non-arteritic anterior ischemic optic neuropathy.

318. The method of embodiment 316, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

319. The method of embodiment 316, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

320. The method of any one of embodiments 281-290, wherein the neurodegenerative disease or disorder results from blood clotting issues, inflammation, obesity, aging, stress, cancer, or diabetes.

321. The method of any one of embodiments 277-320, wherein the subject is a human.

322. The method of any one of embodiments 277-321, wherein the subject is a patient with one or more risk factors for developing a condition involving axonal degeneration.

323. The method of embodiments 322, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

324. The method of embodiment 323, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

325. The method of embodiment 323, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

326. The method of embodiment 323, wherein the one or more biomarkers of neurodegeneration comprises:

concentration of neurofilament light chain protein (NF-L) in one or more of: a cerebrospinal fluid (CSF) sample, a blood sample, and a plasma sample from the subject;

concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-β (Aβ)38, Aβ40, Aβ42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)α, sAPPβ, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

327. A method for treating and/or preventing axonal degeneration in a subject, comprising:

administering to the subject an antisense oligonucleotide that is complementary to a target region of a nucleic acid encoding Sterile Alpha and TIR motif-containing 1 (SARM1), wherein the antisense oligonucleotide comprises a sequence having at least 80% identity SEQ ID NO: 22.

328. The method of embodiment 327, wherein the antisense oligonucleotide comprises a sequence having at least 85% identity to SEQ ID NO: 22.

329. The method of embodiment 327 or embodiment 328, wherein the antisense oligonucleotide comprises a sequence having at least 90% identity to SEQ ID NO: 22.

330. The method of any one of embodiments 327-329, wherein the antisense oligonucleotide comprises SEQ ID NO: 22.

331. A method comprising administering to a subject at risk of developing a neurodegenerative disease or disorder an antisense oligonucleotide that is complementary to a target region of a nucleic acid encoding SARM1, wherein the antisense oligonucleotide comprises a sequence having at least 80% identity SEQ ID NO: 22.

332. The method of embodiment 331, wherein the antisense oligonucleotide comprises a sequence having at least 85% identity to SEQ ID NO: 22.

333. The method of embodiment 331 or embodiment 332, wherein the antisense oligonucleotide comprises a sequence having at least 90% identity to SEQ ID NO: 22.

334. The method of any one of embodiments 331-333, wherein the antisense oligonucleotide comprises SEQ ID NO: 22.

335. The method of any one of embodiments 327-334, wherein the target nucleic acid encoding SARM1 is a SARM1 mRNA.

336. The method of any one of embodiments 327-335, wherein the antisense oligonucleotide comprises one or more modifications.

337. The method of embodiment 336, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

338. The method of any one of embodiments 327-337, wherein administering the antisense oligonucleotide decreases levels of SARM1 mRNA in the subject.

339. The method of any one of embodiments 327-337, wherein administering the antisense oligonucleotide decreases levels of SARM1 protein in the subject.

340. The method of any one of embodiments 331-339, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

341. The method of any of embodiments 331-339, wherein the neurodegenerative disease or disorder comprises a chronic disease or disorder of the PNS.

342. The method of embodiment 341, wherein the chronic disease or disorder of the PNS comprises a systemic disorder, a pain disorder, or a metabolic disease or disorder.

343. The method of embodiment 341, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

344. The method of embodiment 342, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

345. The method of embodiment 342, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

346. The method of embodiment 342, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/ glycolipid metabolism, a nutritional deficiency, a vitamin deficiency, or a mitochondrial disorder.

347. The method of any one of embodiments 331-340, the neurodegenerative disease or disorder comprises an acute disease or disorder of the peripheral nervous system.

348. The method of embodiment 347, wherein the acute disease or disorder of the PNS is the result of a mechanical injury, thermal injury, or injury from a chemical agent or chemotherapy.

349. The method of embodiment 348, wherein the mechanical injury comprises a compression or entrapment injury or a pressure injury.

350. The method of embodiment 348, wherein the compression or entrapment injury comprises carpal tunnel syndrome, direct trauma, a penetrating injury, a contusion, a fracture or a dislocated bone.

351. The method of embodiment 348, wherein the pressure injury comprises pressure involving superficial nerves, pressure from a tumor or increased intraocular pressure.

352. The method of embodiment 348, wherein the chemical agent or chemotherapy comprises a cytotoxic anti-cancer agent, thalidomide, an epothilone, a taxane, a vinca alkaloid, a proteasome inhibitor, a platinum-based drug or an auristatin.

353. The method of embodiment 352, wherein the epothilone is ixabepilone.

354. The method of embodiment 352, wherein the taxane is paclitaxel or docetaxel.

355. The method of embodiment 352, wherein the vinca alkaloid is vinblastine, vinorelbine, vincristine, or vindesine.

356. The method of embodiment 352, wherein the proteasome inhibitor is bortezomib.

357. The method of embodiment 352, wherein the platinum-based drug is cisplatin, oxaliplatin, or carboplatin.

358. The method of embodiment 352, wherein the auristatin is conjugated monomethyl auristatin E.

359. The method of any one of embodiments 331-340, wherein the neurodegenerative disease or disorder comprises a chronic disease or disorder of the CNS.

360. The method of embodiment 359, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

361. The method of embodiment 359, wherein the chronic disease or disorder of the CNS comprises an optic nerve disorder, a traumatic CNS injury, or a metabolic disease or disorder.

362. The method of embodiment 361, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

363. The method of embodiment 361, wherein the traumatic CNS injury comprises a traumatic brain injury (TBI), a spinal cord injury, traumatic axonal injury or chronic traumatic encephalopathy (CTE).

364. The method of embodiment 361, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

365. The method of any one of embodiments 331-340, wherein the neurodegenerative disease or disorder comprises an acute disease or disorder of the CNS.

366. The method of embodiment 365, wherein the acute disease or disorder of the CNS comprises an ischemia, a traumatic CNS injury, injury from a chemical agent, thermal injury, or viral encephalitis.

367. The method of embodiment 366, wherein the ischemia comprises cerebral ischemia, hypoxic demyelination, ischemic demyelination, ischemic optic neuropathy, or non-arteritic anterior ischemic optic neuropathy.

368. The method of embodiment 366, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

369. The method of embodiment 366, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

370. The method of any one of embodiments 331-340, wherein the neurodegenerative disease or disorder results from blood clotting issues, inflammation, obesity, aging, stress, cancer, or diabetes.

371. The method of any one of embodiments 327-370, wherein the subject is a human.

372. The method of any one of embodiments 327-371, wherein the subject is a patient with one or more risk factors for developing a condition involving axonal degeneration.

373. The method of embodiments 372, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

374. The method of embodiment 373, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

375. The method of embodiment 373, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

376. The method of embodiment 373, wherein the one or more biomarkers of neurodegeneration comprises:

concentration of neurofilament light chain protein (NF-L) in one or more of: a cerebrospinal fluid (CSF) sample, a blood sample, and a plasma sample from the subject;

concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-β (Aβ)38, Aβ40, Aβ42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)α, sAPPβ, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

377. A method for treating and/or preventing axonal degeneration in a subject, comprising: administering to the subject an antisense oligonucleotide that is complementary to a target region of a nucleic acid encoding Sterile Alpha and TIR motif-containing 1 (SARM1), wherein the antisense oligonucleotide comprises a sequence having at least 80% identity SEQ ID NO: 38.

378. The method of embodiment 377, wherein the antisense oligonucleotide comprises a sequence having at least 85% identity to SEQ ID NO: 38.

379. The method of embodiment 377 or embodiment 378, wherein the antisense oligonucleotide comprises a sequence having at least 90% identity to SEQ ID NO: 38.

380. The method of any one of embodiments 377-379, wherein the antisense oligonucleotide comprises SEQ ID NO: 38.

381. A method comprising administering to a subject at risk of developing a neurodegenerative disease or disorder an antisense oligonucleotide that is complementary to a target region of a nucleic acid encoding SARM1, wherein the antisense oligonucleotide comprises a sequence having at least 80% identity SEQ ID NO: 38.

382. The method of embodiment 381, wherein the antisense oligonucleotide comprises a sequence having at least 85% identity to SEQ ID NO: 38.

383. The method of embodiment 381 or embodiment 382, wherein the antisense oligonucleotide comprises a sequence having at least 90% identity to SEQ ID NO: 38.

384. The method of any one of embodiments 381-383, wherein the antisense oligonucleotide comprises SEQ ID NO: 38.

385. The method of any one of embodiments 377-384, wherein the target nucleic acid encoding SARM1 is a SARM1 mRNA.

386. The method of any one of embodiments 377-385, wherein the antisense oligonucleotide comprises one or more modifications.

387. The method of embodiment 386, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

388. The method of any one of embodiments 377-387, wherein administering the antisense oligonucleotide decreases levels of SARM1 mRNA in the subject.

389. The method of any one of embodiments 377-387, wherein administering the antisense oligonucleotide decreases levels of SARM1 protein in the subject.

390. The method of any one of embodiments 381-389, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

391. The method of any of embodiments 381-389, wherein the neurodegenerative disease or disorder comprises a chronic disease or disorder of the PNS.

392. The method of embodiment 391, wherein the chronic disease or disorder of the PNS comprises a systemic disorder, a pain disorder, or a metabolic disease or disorder.

393. The method of embodiment 391, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

394. The method of embodiment 392, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

395. The method of embodiment 392, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

396. The method of embodiment 392, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

397. The method of any one of embodiments 381-390, the neurodegenerative disease or disorder comprises an acute disease or disorder of the peripheral nervous system.

398. The method of embodiment 397, wherein the acute disease or disorder of the PNS is the result of a mechanical injury, thermal injury, or injury from a chemical agent or chemotherapy.

399. The method of embodiment 398, wherein the mechanical injury comprises a compression or entrapment injury or a pressure injury.

400. The method of embodiment 398, wherein the compression or entrapment injury comprises carpal tunnel syndrome, direct trauma, a penetrating injury, a contusion, a fracture or a dislocated bone.

401. The method of embodiment 398, wherein the pressure injury comprises pressure involving superficial nerves, pressure from a tumor or increased intraocular pressure.

402. The method of embodiment 398, wherein the chemical agent or chemotherapy comprises a cytotoxic anti-cancer agent, thalidomide, an epothilone, a taxane, a vinca alkaloid, a proteasome inhibitor, a platinum-based drug or an auristatin.

403. The method of embodiment 402, wherein the epothilone is ixabepilone.

404. The method of embodiment 402, wherein the taxane is paclitaxel or docetaxel.

405. The method of embodiment 402, wherein the vinca alkaloid is vinblastine, vinorelbine, vincristine, or vindesine.

406. The method of embodiment 402, wherein the proteasome inhibitor is bortezomib.

407. The method of embodiment 402, wherein the platinum-based drug is cisplatin, oxaliplatin, or carboplatin.

408. The method of embodiment 402, wherein the auristatin is conjugated monomethyl auristatin E.

409. The method of any one of embodiments 381-390, wherein the neurodegenerative disease or disorder comprises a chronic disease or disorder of the CNS.

410. The method of embodiment 409, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

411. The method of embodiment 409, wherein the chronic disease or disorder of the CNS comprises an optic nerve disorder, a traumatic CNS injury, or a metabolic disease or disorder.

412. The method of embodiment 411, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

413. The method of embodiment 411, wherein the traumatic CNS injury comprises a traumatic brain injury (TBI), a spinal cord injury, traumatic axonal injury or chronic traumatic encephalopathy (CTE).

414. The method of embodiment 411, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

415. The method of any one of embodiments 381-390, wherein the neurodegenerative disease or disorder comprises an acute disease or disorder of the CNS.

416. The method of embodiment 415, wherein the acute disease or disorder of the CNS comprises an ischemia, a traumatic CNS injury, injury from a chemical agent, thermal injury, or viral encephalitis.

417. The method of embodiment 416, wherein the ischemia comprises cerebral ischemia, hypoxic demyelination, ischemic demyelination, ischemic optic neuropathy, or non-arteritic anterior ischemic optic neuropathy.

418. The method of embodiment 416, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

419. The method of embodiment 416, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

420. The method of any one of embodiments 381-390, wherein the neurodegenerative disease or disorder results from blood clotting issues, inflammation, obesity, aging, stress, cancer, or diabetes.

421. The method of any one of embodiments 377-420, wherein the subject is a human.

422. The method of any one of embodiments 377-421, wherein the subject is a patient with one or more risk factors for developing a condition involving axonal degeneration.

423. The method of embodiments 422, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

424. The method of embodiment 423, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

425. The method of embodiment 423, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

426. The method of embodiment 423, wherein the one or more biomarkers of neurodegeneration comprises:

concentration of neurofilament light chain protein (NF-L) in one or more of: a cerebrospinal fluid (CSF) sample, a blood sample, and a plasma sample from the subject;

concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-$\beta$ (A$\beta$)38, A$\beta$40, A$\beta$42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)$\alpha$, sAPP$\beta$, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

427. A method for treating and/or preventing axonal degeneration in a subject, comprising:

administering to the subject an antisense oligonucleotide that is complementary to a target region of a nucleic acid encoding Sterile Alpha and TIR motif-containing 1 (SARM1), wherein the antisense oligonucleotide comprises a sequence having at least 80% identity SEQ ID NO: 549.

428. The method of embodiment 427, wherein the antisense oligonucleotide comprises a sequence having at least 85% identity to SEQ ID NO: 549.

429. The method of embodiment 427 or embodiment 428, wherein the antisense oligonucleotide comprises a sequence having at least 90% identity to SEQ ID NO: 549.

430. The method of any one of embodiments 427-429, wherein the antisense oligonucleotide comprises SEQ ID NO: 549.

431. A method comprising administering to a subject at risk of developing a neurodegenerative disease or disorder an antisense oligonucleotide that is complementary to a target region of a nucleic acid encoding SARM1, wherein the antisense oligonucleotide comprises a sequence having at least 80% identity SEQ ID NO: 549.

432. The method of embodiment 431, wherein the antisense oligonucleotide comprises a sequence having at least 85% identity to SEQ ID NO: 549.

433. The method of embodiment 431 or embodiment 432, wherein the antisense oligonucleotide comprises a sequence having at least 90% identity to SEQ ID NO: 549.

434. The method of any one of embodiments 431-433, wherein the antisense oligonucleotide comprises SEQ ID NO: 549.

435. The method of any one of embodiments 427-434, wherein the target nucleic acid encoding SARM1 is a SARM1 mRNA.

436. The method of any one of embodiments 427-425, wherein the antisense oligonucleotide comprises one or more modifications.

437. The method of embodiment 436, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

438. The method of any one of embodiments 427-437, wherein administering the antisense oligonucleotide decreases levels of SARM1 mRNA in the subject.

439. The method of any one of embodiments 427-437, wherein administering the antisense oligonucleotide decreases levels of SARM1 protein in the subject.

440. The method of any one of embodiments 431-439, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

441. The method of any of embodiments 431-439, wherein the neurodegenerative disease or disorder comprises a chronic disease or disorder of the PNS.

442. The method of embodiment 441, wherein the chronic disease or disorder of the PNS comprises a systemic disorder, a pain disorder, or a metabolic disease or disorder.

443. The method of embodiment 441, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

444. The method of embodiment 442, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

445. The method of embodiment 442, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

446. The method of embodiment 442, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

447. The method of any one of embodiments 431-440, the neurodegenerative disease or disorder comprises an acute disease or disorder of the peripheral nervous system.

448. The method of embodiment 447, wherein the acute disease or disorder of the PNS is the result of a mechanical injury, thermal injury, or injury from a chemical agent or chemotherapy.

449. The method of embodiment 448, wherein the mechanical injury comprises a compression or entrapment injury or a pressure injury.

450. The method of embodiment 448, wherein the compression or entrapment injury comprises carpal tunnel syndrome, direct trauma, a penetrating injury, a contusion, a fracture or a dislocated bone.

451. The method of embodiment 448, wherein the pressure injury comprises pressure involving superficial nerves, pressure from a tumor or increased intraocular pressure.

452. The method of embodiment 448, wherein the chemical agent or chemotherapy comprises a cytotoxic anti-cancer agent, thalidomide, an epothilone, a taxane, a vinca alkaloid, a proteasome inhibitor, a platinum-based drug or an auristatin.

453. The method of embodiment 452, wherein the epothilone is ixabepilone.

454. The method of embodiment 452, wherein the taxane is paclitaxel or docetaxel.

455. The method of embodiment 452, wherein the vinca alkaloid is vinblastine, vinorelbine, vincristine, or vindesine.

456. The method of embodiment 452, wherein the proteasome inhibitor is bortezomib.

457. The method of embodiment 452, wherein the platinum-based drug is cisplatin, oxaliplatin, or carboplatin.

458. The method of embodiment 452, wherein the auristatin is conjugated monomethyl auristatin E.

459. The method of any one of embodiments 431-440, wherein the neurodegenerative disease or disorder comprises a chronic disease or disorder of the CNS.

460. The method of embodiment 459, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

461. The method of embodiment 459, wherein the chronic disease or disorder of the CNS comprises an optic nerve disorder, a traumatic CNS injury, or a metabolic disease or disorder.

462. The method of embodiment 461, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

463. The method of embodiment 461, wherein the traumatic CNS injury comprises a traumatic brain injury (TBI), a spinal cord injury, traumatic axonal injury or chronic traumatic encephalopathy (CTE).

464. The method of embodiment 461, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

465. The method of any one of embodiments 431-440, wherein the neurodegenerative disease or disorder comprises an acute disease or disorder of the CNS.

466. The method of embodiment 465, wherein the acute disease or disorder of the CNS comprises an ischemia, a traumatic CNS injury, injury from a chemical agent, thermal injury, or viral encephalitis.

467. The method of embodiment 465, wherein the ischemia comprises cerebral ischemia, hypoxic demyelination, ischemic demyelination, ischemic optic neuropathy, or non-arteritic anterior ischemic optic neuropathy.

468. The method of embodiment 465, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

469. The method of embodiment 465, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

470. The method of any one of embodiments 431-440, wherein the neurodegenerative disease or disorder results from blood clotting issues, inflammation, obesity, aging, stress, cancer, or diabetes.

471. The method of any one of embodiments 427-470, wherein the subject is a human.

472. The method of any one of embodiments 427-471, wherein the subject is a patient with one or more risk factors for developing a condition involving axonal degeneration.

473. The method of embodiments 472, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

474. The method of embodiment 473, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

475. The method of embodiment 473, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

476. The method of embodiment 473, wherein the one or more biomarkers of neurodegeneration comprises:

concentration of neurofilament light chain protein (NF-L) in one or more of: a cerebrospinal fluid (CSF) sample, a blood sample, and a plasma sample from the subject;

concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-$\beta$ (A$\beta$)38, A$\beta$40, A$\beta$42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)$\alpha$, sAPP$\beta$, soluble triggering receptor expressed on myeloid cells (sTREM) 2, phospho-tau, or total-tau in one or more of: a cerebrospinal fluid biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

477. An antisense oligonucleotide comprising a sequence having at least 80% identity to SEQ ID NO: 2410.

478. The antisense oligonucleotide of embodiment 477, comprising a sequence having at least 85% identity to SEQ ID NO: 2410.

479. The antisense oligonucleotide of embodiment 477 or embodiment 478, comprising a sequence having at least 90% identity to SEQ ID NO: 2410.

480. The antisense oligonucleotide of any one of embodiments 477-479, comprising SEQ ID NO: 2410.

481. The antisense oligonucleotide of any one of embodiments 477-480, wherein the antisense oligonucleotide comprises one or more modifications.

482. The antisense oligonucleotide of embodiment 481, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

483. A pharmaceutical composition comprising an antisense oligonucleotide of any one embodiments 477-482.

484. The pharmaceutical composition of embodiment 483, wherein the pharmaceutical composition comprises a pharmaceutically acceptable carrier.

485. A method for treating and/or preventing axonal degeneration in a subject, comprising:
   administering to the subject an antisense oligonucleotide is complementary to a target region of a nucleic acid encoding Sterile Alpha and TIR motif-containing 1 (SARM1).

486. A method comprising administering to a subject at risk of developing a neurodegenerative disease or disorder an antisense oligonucleotide that is complementary to a target region of a nucleic acid encoding SARM1.

487. The method of embodiment 485 or embodiment 486, wherein the target nucleic acid encoding SARM1 is a SARM1 mRNA.

488. The method of any one of embodiments 485-487, wherein the antisense oligonucleotide comprises a sequence having at least 80% identity to SEQ ID NO: 2410.

489. The method of any one of embodiments 485-488, wherein the antisense oligonucleotide comprises a sequence having at least 85% identity to SEQ ID NO: 2410.

490. The method of any one of embodiments 485-489, wherein the antisense oligonucleotide comprises a sequence having at least 90% identity to SEQ ID NO: 2410.

491. The method of any one of embodiments 485-490, wherein the antisense oligonucleotide comprises SEQ ID NO: 2410.

492. The method of any one of embodiments 485-491, wherein the antisense oligonucleotide comprises one or more modifications.

493. The method of embodiment 492, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

494. The method of any one of embodiments 485-493, wherein administering the antisense oligonucleotide decreases levels of SARM1 mRNA in the subject.

495. The method of any one of embodiments 485-493, wherein administering the antisense oligonucleotide decreases levels of SARM1 protein in the subject.

496. The method of any one of embodiments 486-495, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

497. The method of any of embodiments 486-495, wherein the neurodegenerative disease or disorder comprises a chronic disease or disorder of the PNS.

498. The method of embodiment 497, wherein the chronic disease or disorder of the PNS comprises a systemic disorder, a pain disorder, or a metabolic disease or disorder.

499. The method of embodiment 497, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

500. The method of embodiment 498, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

501. The method of embodiment 498, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

502. The method of embodiment 498, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

503. The method of any one of embodiments 486-496, the neurodegenerative disease or disorder comprises an acute disease or disorder of the peripheral nervous system.

504. The method of embodiment 503, wherein the acute disease or disorder of the PNS is the result of a mechanical injury, thermal injury, or injury from a chemical agent or chemotherapy.

505. The method of embodiment 504, wherein the mechanical injury comprises a compression or entrapment injury or a pressure injury.

506. The method of embodiment 505, wherein the compression or entrapment injury comprises carpal tunnel syndrome, direct trauma, a penetrating injury, a contusion, a fracture or a dislocated bone.

507. The method of embodiment 505, wherein the pressure injury comprises pressure involving superficial nerves, pressure from a tumor or increased intraocular pressure.

508. The method of embodiment 504, wherein the chemical agent or chemotherapy comprises a cytotoxic anticancer agent, thalidomide, an epothilone, a taxane, a vinca alkaloid, a proteasome inhibitor, a platinum-based drug or an auristatin.

509. The method of embodiment 508, wherein the epothilone is ixabepilone.

510. The method of embodiment 508, wherein the taxane is paclitaxel or docetaxel.

511. The method of embodiment 508, wherein the vinca alkaloid is vinblastine, vinorelbine, vincristine, or vindesine.

512. The method of embodiment 508, wherein the proteasome inhibitor is bortezomib.

513. The method of embodiment 508, wherein the platinum-based drug is cisplatin, oxaliplatin, or carboplatin.

514. The method of embodiment 508, wherein the auristatin is conjugated monomethyl auristatin E.

515. The method of any one of embodiments 486-496, wherein the neurodegenerative disease or disorder comprises a chronic disease or disorder of the CNS.

516. The method of embodiment 515, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

517. The method of embodiment 515, wherein the chronic disease or disorder of the CNS comprises an optic nerve disorder, a traumatic CNS injury, or a metabolic disease or disorder.

518. The method of embodiment 517, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

519. The method of embodiment 517, wherein the traumatic CNS injury comprises a traumatic brain injury (TBI), a spinal cord injury, traumatic axonal injury or chronic traumatic encephalopathy (CTE).

520. The method of embodiment 517, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

521. The method of any one of embodiments 486-496, wherein the neurodegenerative disease or disorder comprises an acute disease or disorder of the CNS.

522. The method of embodiment 521, wherein the acute disease or disorder of the CNS comprises an ischemia, a traumatic CNS injury, injury from a chemical agent, thermal injury, or viral encephalitis.

523. The method of embodiment 522, wherein the ischemia comprises cerebral ischemia, hypoxic demyelination, ischemic demyelination, ischemic optic neuropathy, or non-arteritic anterior ischemic optic neuropathy.

524. The method of embodiment 522, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

525. The method of embodiment 522, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

526. The method of any one of embodiments 486-496, wherein the neurodegenerative disease or disorder results from blood clotting issues, inflammation, obesity, aging, stress, cancer, or diabetes.

527. The method of any one of embodiments 485-526, wherein the subject is a human.

528. The method of any one of embodiments 485-527, wherein the subject is a patient with one or more risk factors for developing a condition involving axonal degeneration.

529. The method of embodiments 528, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

530. The method of embodiment 529, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

531. The method of embodiment 529, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

532. The method of embodiment 529, wherein the one or more biomarkers of neurodegeneration comprises:
    concentration of neurofilament light chain protein (NF-L) in one or more of: a cerebrospinal fluid (CSF) sample, a blood sample, and a plasma sample from the subject;
    concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-β (Aβ)38, Aβ40, Aβ42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)α, sAPPβ, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

533. An antisense oligonucleotide comprising a sequence having at least 80% identity to SEQ ID NO: 2411.

534. The antisense oligonucleotide of embodiment 533, comprising a sequence having at least 85% identity to SEQ ID NO: 2411.

535. The antisense oligonucleotide of embodiment 533 or embodiment 534, comprising a sequence having at least 90% identity to SEQ ID NO: 2411.

536. The antisense oligonucleotide of any one of embodiments 533-535, comprising SEQ ID NO: 2411.

537. The antisense oligonucleotide of any one of embodiments 533-536, wherein the antisense oligonucleotide comprises one or more modifications.

538. The antisense oligonucleotide of embodiment 537, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

539. A pharmaceutical composition comprising an antisense oligonucleotide of any one embodiments 533-538.

540. The pharmaceutical composition of embodiment 539, wherein the pharmaceutical composition comprises a pharmaceutically acceptable carrier.

541. A method for treating and/or preventing axonal degeneration in a subject, comprising:

administering to the subject an antisense oligonucleotide is complementary to a target region of a nucleic acid encoding Sterile Alpha and TIR motif-containing 1 (SARM1).

542. A method comprising administering to a subject at risk of developing a neurodegenerative disease or disorder an antisense oligonucleotide that is complementary to a target region of a nucleic acid encoding SARM1.

543. The method of embodiment 541 or embodiment 542, wherein the target nucleic acid encoding SARM1 is a SARM1 mRNA.

544. The method of any one of embodiments 541-543, wherein the antisense oligonucleotide comprises a sequence having at least 80% identity to SEQ ID NO: 2411.

545. The method of any one of embodiments 541-544, wherein the antisense oligonucleotide comprises a sequence having at least 85% identity to SEQ ID NO: 2411.

546. The method of any one of embodiments 541-545, wherein the antisense oligonucleotide comprises a sequence having at least 90% identity to SEQ ID NO: 2411.

547. The method of any one of embodiments 541-546, wherein the antisense oligonucleotide comprises SEQ ID NO: 2411.

548. The method of any one of embodiments 541-547, wherein the antisense oligonucleotide comprises one or more modifications.

549. The method of embodiment 548, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

550. The method of any one of embodiments 541-549, wherein administering the antisense oligonucleotide decreases levels of SARM1 mRNA in the subject.

551. The method of any one of embodiments 541-549, wherein administering the antisense oligonucleotide decreases levels of SARM1 protein in the subject.

552. The method of any one of embodiments 542-551, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

553. The method of any of embodiments 542-551, wherein the neurodegenerative disease or disorder comprises a chronic disease or disorder of the PNS.

554. The method of embodiment 553, wherein the chronic disease or disorder of the PNS comprises a systemic disorder, a pain disorder, or a metabolic disease or disorder.

555. The method of embodiment 553, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

556. The method of embodiment 554, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

557. The method of embodiment 554, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

558. The method of embodiment 554, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

559. The method of any one of embodiments 542-552, the neurodegenerative disease or disorder comprises an acute disease or disorder of the peripheral nervous system.

560. The method of embodiment 559, wherein the acute disease or disorder of the PNS is the result of a mechanical injury, thermal injury, or injury from a chemical agent or chemotherapy.

561. The method of embodiment 560, wherein the mechanical injury comprises a compression or entrapment injury or a pressure injury.

562. The method of embodiment 561, wherein the compression or entrapment injury comprises carpal tunnel syndrome, direct trauma, a penetrating injury, a contusion, a fracture or a dislocated bone.

563. The method of embodiment 561, wherein the pressure injury comprises pressure involving superficial nerves, pressure from a tumor or increased intraocular pressure.

564. The method of embodiment 560, wherein the chemical agent or chemotherapy comprises a cytotoxic anticancer agent, thalidomide, an epothilone, a taxane, a vinca alkaloid, a proteasome inhibitor, a platinumbased drug or an auristatin.

565. The method of embodiment 564, wherein the epothilone is ixabepilone.

566. The method of embodiment 564, wherein the taxane is paclitaxel or docetaxel.

567. The method of embodiment 564, wherein the vinca alkaloid is vinblastine, vinorelbine, vincristine, or vindesine.

568. The method of embodiment 564, wherein the proteasome inhibitor is bortezomib.

569. The method of embodiment 564, wherein the platinum-based drug is cisplatin, oxaliplatin, or carboplatin.

570. The method of embodiment 564, wherein the auristatin is conjugated monomethyl auristatin E.

571. The method of any one of embodiments 542-552, wherein the neurodegenerative disease or disorder comprises a chronic disease or disorder of the CNS.

572. The method of embodiment 571, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

573. The method of embodiment 571, wherein the chronic disease or disorder of the CNS comprises an optic nerve disorder, a traumatic CNS injury, or a metabolic disease or disorder.

574. The method of embodiment 573, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

575. The method of embodiment 573, wherein the traumatic CNS injury comprises a traumatic brain injury (TBI), a spinal cord injury, traumatic axonal injury or chronic traumatic encephalopathy (CTE).

576. The method of embodiment 573, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

577. The method of any one of embodiments 542-552, wherein the neurodegenerative disease or disorder comprises an acute disease or disorder of the CNS.

578. The method of embodiment 577, wherein the acute disease or disorder of the CNS comprises an ischemia, a traumatic CNS injury, injury from a chemical agent, thermal injury, or viral encephalitis.

579. The method of embodiment 578, wherein the ischemia comprises cerebral ischemia, hypoxic demyelination, ischemic demyelination, ischemic optic neuropathy, or non-arteritic anterior ischemic optic neuropathy.

580. The method of embodiment 578, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

581. The method of embodiment 578, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

581. The method of any one of embodiments 542-552, wherein the neurodegenerative disease or disorder results from blood clotting issues, inflammation, obesity, aging, stress, cancer, or diabetes.

582. The method of any one of embodiments 541-581, wherein the subject is a human.

583. The method of any one of embodiments 541-582, wherein the subject is a patient with one or more risk factors for developing a condition involving axonal degeneration.

584. The method of embodiments 583, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

585. The method of embodiment 584, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

586. The method of embodiment 584, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

587. The method of embodiment 584, wherein the one or more biomarkers of neurodegeneration comprises:

concentration of neurofilament light chain protein (NF-L) in one or more of: a cerebrospinal fluid (CSF) sample, a blood sample, and a plasma sample from the subject;

concentration of neurofilament heavy chain protein (NF-H) in one or more of: a cerebrospinal fluid (CSF) sample, a blood sample, and a plasma sample from the subject;

concentration of Ubiquitin C-terminal Hydrolase L1 (UCH-L1) in one or more of: a cerebrospinal fluid (CSF) sample, a blood sample, and a plasma sample from the subject;

concentration of alpha-synuclein in one or more of: a cerebrospinal fluid (CSF) sample, a blood sample, and a plasma sample from the subject;

constitutive NAD+ levels in neurons and/or axons of the subject;

constitutive cADPR levels in neurons and/or axons of the subject;

levels of albumin, amyloid-β (Aβ)38, Aβ40, Aβ42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)α, sAPPβ, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

588. An antisense oligonucleotide comprising a sequence having at least 80% identity to SEQ ID NO: 2412.

589. The antisense oligonucleotide of embodiment 588, comprising a sequence having at least 85% identity to SEQ ID NO: 2412.

590. The antisense oligonucleotide of embodiment 588 or embodiment 589, comprising a sequence having at least 90% identity to SEQ ID NO: 2412.

591. The antisense oligonucleotide of any one of embodiments 588-590, comprising SEQ ID NO: 2412.

592. The antisense oligonucleotide of any one of embodiments 588-591, wherein the antisense oligonucleotide comprises one or more modifications.

593. The antisense oligonucleotide of embodiment 592, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

594. A pharmaceutical composition comprising an antisense oligonucleotide of any one embodiments 588-593.

595. The pharmaceutical composition of embodiment 594, wherein the pharmaceutical composition comprises a pharmaceutically acceptable carrier.

596. A method for treating and/or preventing axonal degeneration in a subject, comprising:

administering to the subject an antisense oligonucleotide is complementary to a target region of a nucleic acid encoding Sterile Alpha and TIR motif-containing 1 (SARM1).

597. A method comprising administering to a subject at risk of developing a neurodegenerative disease or disorder an antisense oligonucleotide that is complementary to a target region of a nucleic acid encoding SARM1.

598. The method of embodiment 596 or embodiment 597, wherein the target nucleic acid encoding SARM1 is a SARM1 mRNA.

599. The method of any one of embodiments 596-598, wherein the antisense oligonucleotide comprises a sequence having at least 80% identity to SEQ ID NO: 2412.

600. The method of any one of embodiments 596-599, wherein the antisense oligonucleotide comprises a sequence having at least 85% identity to SEQ ID NO: 2412.

601. The method of any one of embodiments 596-600, wherein the antisense oligonucleotide comprises a sequence having at least 90% identity to SEQ ID NO: 2412.

602. The method of any one of embodiments 596-601, wherein the antisense oligonucleotide comprises SEQ ID NO: 2412.

603. The method of any one of embodiments 596-602, wherein the antisense oligonucleotide comprises one or more modifications.

604. The method of embodiment 603, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

605. The method of any one of embodiments 596-604, wherein administering the antisense oligonucleotide decreases levels of SARM1 mRNA in the subject.

606. The method of any one of embodiments 596-604, wherein administering the antisense oligonucleotide decreases levels of SARM1 protein in the subject.

607. The method of any one of embodiments 597-606, wherein the neurodegenerative disease or disorder comprises an acute or chronic disease or disorder of the peripheral nervous system (PNS), an acute or chronic disease or disorder of the central nervous system (CNS), or a disease associated with neurodegeneration.

608. The method of any of embodiments 597-606, wherein the neurodegenerative disease or disorder comprises a chronic disease or disorder of the PNS.

609. The method of embodiment 608, wherein the chronic disease or disorder of the PNS comprises a systemic disorder, a pain disorder, or a metabolic disease or disorder.

610. The method of embodiment 608, wherein the chronic disease or disorder of the PNS comprises inherited neuropathies, Charcot-Marie-Tooth disease, hereditary sensory and autonomic neuropathy (HSAN), chronic inflammatory demyelinating polyneuropathy (CIDP), idiopathic neuropathies or other peripheral neuropathies.

611. The method of embodiment 609, wherein the systemic disorder comprises diabetes, uremia, AIDS, leprosy, a nutritional deficiency, atherosclerosis, an enteric neuropathy, an axonopathy, Guillain-Barre syndrome, severe acute motor axonal neuropathy (AMAN), systemic lupus erythematosus, scleroderma, sarcoidosis, rheumatoid arthritis, or polyarteritis nodosa.

612. The method of embodiment 609, wherein the pain disorder comprises chronic pain, fibromyalgia, spinal pain, carpal tunnel syndrome, pain from cancer, arthritis, sciatica, headaches, pain from surgery, muscle spasms, back pain, visceral pain, pain from injury, dental pain, neurogenic pain, neuropathic pain, nerve inflammation, nerve damage, shingles, herniated disc, torn ligament, or diabetes.

613. The method of embodiment 609, wherein the metabolic disease or disorder comprises diabetes mellitus, hypoglycemia, uremia, hypothyroidism, hepatic failure, polycythemia, amyloidosis, acromegaly, porphyria, nonalcoholic fatty liver disease (NAFLD), nonalcoholic steatohepatitis (NASH), disorders of lipid/glycolipid metabolism, a nutritional deficiency, a vitamin deficiency, or a mitochondrial disorder.

614. The method of any one of embodiments 597-607, the neurodegenerative disease or disorder comprises an acute disease or disorder of the peripheral nervous system.

615. The method of embodiment 614, wherein the acute disease or disorder of the PNS is the result of a mechanical injury, thermal injury, or injury from a chemical agent or chemotherapy.

616. The method of embodiment 615, wherein the mechanical injury comprises a compression or entrapment injury or a pressure injury.

617. The method of embodiment 616, wherein the compression or entrapment injury comprises carpal tunnel syndrome, direct trauma, a penetrating injury, a contusion, a fracture or a dislocated bone.

618. The method of embodiment 616, wherein the pressure injury comprises pressure involving superficial nerves, pressure from a tumor or increased intraocular pressure.

619. The method of embodiment 615, wherein the chemical agent or chemotherapy comprises a cytotoxic anti-cancer agent, thalidomide, an epothilone, a taxane, a vinca alkaloid, a proteasome inhibitor, a platinum-based drug or an auristatin.

620. The method of embodiment 619, wherein the epothilone is ixabepilone.

621. The method of embodiment 619, wherein the taxane is paclitaxel or docetaxel.

622. The method of embodiment 619, wherein the vinca alkaloid is vinblastine, vinorelbine, vincristine, or vindesine.

623. The method of embodiment 619, wherein the proteasome inhibitor is bortezomib.

624. The method of embodiment 619, wherein the platinum-based drug is cisplatin, oxaliplatin, or carboplatin.

625. The method of embodiment 619, wherein the auristatin is conjugated monomethyl auristatin E.

626. The method of any one of embodiments 597-607, wherein the neurodegenerative disease or disorder comprises a chronic disease or disorder of the CNS.

627. The method of embodiment 626, wherein the chronic disease or disorder of the CNS comprises Alzheimer's disease, Parkinson's disease, amyotrophic lateral sclerosis (ALS, Lou Gehrig's disease), multiple sclerosis (MS), Huntington's disease (HD), senile dementia, Pick's disease, Gaucher's disease, Hurler syndrome, progressive multifocal leukoencephalopathy, Alexander's disease, congenital hypomyelination, encephalomyelitis, acute disseminated encephalomyelitis, central pontine myelolysis, osmotic hyponatremia, Tay-Sachs disease, motor neuron disease, ataxia, spinal muscular atrophy (SMA), Niemann-Pick disease, acute hemorrhagic leukoencephalitis, trigeminal neuralgia, Bell's palsy, cerebral ischemia, multiple system atrophy, Pelizaeus Merzbacher disease, periventricular leukomalacia, a hereditary ataxia, noise-induced hearing loss, congenital hearing loss, age-related hearing loss, Creutzfeldt-Jakob disease, transmissible spongiform encephalopathy, Lewy Body Dementia, frontotemporal dementia, amyloidosis, diabetic neuropathy, globoid cell leukodystrophy (Krabbe's disease), Bassen-Kornzweig syndrome, transverse myelitis, motor neuron disease, a spinocerebellar ataxia, pre-eclampsia, hereditary spastic paraplegias, spastic paraparesis, familial spastic paraplegia, French settlement disease, Strumpell-Lorrain disease, non-alcoholic steatohepatitis (NASH), adrenomyeloneuropathy, progressive supra nuclear palsy (PSP), Friedrich's ataxia, or spinal cord injury.

628. The method of embodiment 626, wherein the chronic disease or disorder of the CNS comprises an optic nerve disorder, a traumatic CNS injury, or a metabolic disease or disorder.

629. The method of embodiment 628, wherein the optic nerve disorder comprises an acute optic neuropathy (AON), a genetic or idiopathic retinal condition, Leber congenital amaurosis (LCA), Leber hereditary optic neuropathy (LHON), primary open-angle glaucoma (POAG), acute angle-closure glaucoma (AACG), autosomal dominant optic atrophy, retinal ganglion degeneration, retinitis pigmentosa, an outer retinal neuropathy, optic nerve neuritis, optic nerve degeneration associated with multiple sclerosis, Kjer's optic neuropathy, an ischemic optic neuropathy, a deficiency in vitamin B12, a deficiency in folic acid (vitamin B9), isolated vitamin E deficiency syndrome, non-arteritic anterior ischemic optic neuropathy, exposure to ethambutol, or exposure to cyanide.

630. The method of embodiment 628, wherein the traumatic CNS injury comprises a traumatic brain injury (TBI), a spinal cord injury, traumatic axonal injury or chronic traumatic encephalopathy (CTE).

631. The method of embodiment 628, wherein the metabolic disease or disorder comprises diabetes mellitus, hypoglycemia, Bassen-Kornzweig syndrome, uremia, hypothyroidism, hepatic failure, polycythemia, amyloidosis, acromegaly, porphyria, disorders of lipid/glycolipid metabolism, nutritional/vitamin deficiencies, and mitochondrial disorders.

632. The method of any one of embodiments 597-607, wherein the neurodegenerative disease or disorder comprises an acute disease or disorder of the CNS.

633. The method of embodiment 632, wherein the acute disease or disorder of the CNS comprises an ischemia, a traumatic CNS injury, injury from a chemical agent, thermal injury, or viral encephalitis.

634. The method of embodiment 633, wherein the ischemia comprises cerebral ischemia, hypoxic demyelination, ischemic demyelination, ischemic optic neuropathy, or non-arteritic anterior ischemic optic neuropathy.

635. The method of embodiment 633, wherein the traumatic CNS injury comprises a spinal cord injury, a TBI, a mechanical injury to the head and/or spine, a traumatic injury to the head and/or spine, blunt force trauma, closed head injury, open head injury, exposure to a concussive and/or explosive force, a penetrating injury to the CNS, increased intraocular pressure, or damage from a force which causes axons to deform, stretch, crush or sheer.

636. The method of embodiment 633, wherein the viral encephalitis comprises enterovirus encephalitis, arbovirus encephalitis, herpes simplex virus (HSV) encephalitis, West Nile virus encephalitis, La Crosse encephalitis, Bunyavirus encephalitis, pediatric viral encephalitis, or HIV encephalopathy (HIV-associated dementia).

637. The method of any one of embodiments 597-6070, wherein the neurodegenerative disease or disorder results from blood clotting issues, inflammation, obesity, aging, stress, cancer, or diabetes.

638. The method of any one of embodiments 596-637, wherein the subject is a human.

639. The method of any one of embodiments 596-638, wherein the subject is a patient with one or more risk factors for developing a condition involving axonal degeneration.

640. The method of embodiments 639, wherein the one or more risk factors for developing a condition involving axonal degeneration comprise age, one or more genetic risk factors for neurodegeneration, family history, engaging in one or more high-risk activities, one or more biomarkers of neurodegeneration, or a combination thereof.

641. The method of embodiment 640, wherein the one or more genetic risk factors for neurodegeneration comprise one or more copies of a known genetic risk factor, a hexanucleotide repeat expansion in chromosome 9 open reading frame 72, one or more copies of the ApoE4 allele, or a combination thereof.

642. The method of embodiment 640, wherein engaging in one or more high-risk activities comprises participating in an activity comprising American football, basketball, boxing, diving, field hockey, football, ice hockey, lacrosse, martial arts, rodeo, rugby, ski jumping, water polo, wrestling, baseball, cycling, cheerleading, fencing, track and field, gymnastics, handball, horseback riding, skating, skiing, skateboarding, softball, squash, ultimate Frisbee, volleyball, or windsurfing.

643. The method of embodiment 640, wherein the one or more biomarkers of neurodegeneration comprises:
  concentration of neurofilament light chain protein (NF-L) in one or more of: a cerebrospinal fluid (CSF) sample, a blood sample, and a plasma sample from the subject;
  concentration of neurofilament heavy chain protein (NF-H) in one or more of: a cerebrospinal fluid (CSF) sample, a blood sample, and a plasma sample from the subject;
  concentration of Ubiquitin C-terminal Hydrolase L1 (UCH-L1) in one or more of: a cerebrospinal fluid (CSF) sample, a blood sample, and a plasma sample from the subject;
  concentration of alpha-synuclein in one or more of: a cerebrospinal fluid (CSF) sample, a blood sample, and a plasma sample from the subject;
  constitutive NAD+ levels in neurons and/or axons of the subject;
  constitutive cADPR levels in neurons and/or axons of the subject;
  levels of albumin, amyloid-$\beta$ (A$\beta$)38, A$\beta$40, A$\beta$42, glial fibrillary acid protein (GFAP), heart-type fatty acid binding protein (hFABP), monocyte chemoattractin protein (MCP)-1, neurogranin, neuron specific enolayse (NSE), soluble amyloid precursor protein (sAPP)$\alpha$, sAPP$\beta$, soluble triggering receptor expressed on myeloid cells (sTREM) 2, phospho-tau, or total-tau in one or more of: a cerebrospinal fluid (CSF) sample, a blood sample, a plasma sample, skin biopsy sample, a nerve biopsy sample, and a brain biopsy sample from the subject; and
  levels of C—C Motif Chemokine Ligand (CCL)2, CCL7, CCL12, colony stimulating factor (CSF)1, or Interleukin (IL)6 in one or more of: a cerebrospinal fluid (CSF) sample, a blood sample, a plasma sample, skin biopsy sample, a nerve biopsy sample, and a brain biopsy sample from the subject.

644. The antisense oligonucleotide, pharmaceutical composition, or method of any one of embodiments 1-643, wherein the antisense oligonucleotide is complementary to a target region of a nucleic acid encoding Sterile Alpha and TIR motif-containing 1 (SARM1).

645. The antisense oligonucleotide, pharmaceutical composition, or method of any one of embodiments 1-644, wherein the antisense oligonucleotide comprises internucleotide linkages of the pattern $R_S R_O R_S R_O R_S D_S D_S D_S D_S D_S D_S D_S D_S D_S R_O R_S R_O R_S$, wherein $R_S$ is an RNA (2'-MOE) phosphorothioate bond, $R_O$ is an RNA (2'-MOE) phosphodiester bond and $D_S$ is a DNA phosophorothioate bond.

EXAMPLES

The present teachings, including descriptions provided in the Examples, are not intended to limit the scope of any claim. Unless specifically presented in the past tense, inclusion in the Examples is not intended to imply that the experiments were actually performed. The following non-limiting examples are provided to further illustrate the present teachings. Those of skill in the art, in light of the present disclosure, will appreciate that many changes can be made in the specific embodiments that are disclosed and still obtain a like or similar result without departing from the spirit and scope of the present teachings.

Example 1: Antisense Modulation of SARM1 Transcript in Human Neuroblastoma Cell Line This Example illustrates an in vitro assay used to characterize oligonucleotides. Antisense oligonucleotides complementary to different regions the SARM1 transcript were synthesized and tested for their ability to inhibit the SARM1 transcript in vitro in a human neuroblastoma cell line.

Human Neuroblastoma Cell Line

The human neuroblastoma cell line SH-SY5Y (ATCC-CRL-2266) was cultured in DMEM medium (Sigma-Aldrich) supplemented with 10% fetal bovine serum (Gibco) and 1 mM penicillin-streptomycin (Sigma). Cultures were plated at a density of 100,000 cells/well in a 24-well tissue culture plate coated with poly-D-Lysine (0.1 mg/ml; Sigma) and laminin (3 mg/mL; Invitrogen). Cells were allowed to adhere to the plates in a humidified tissue culture incubator (5% $CO_2$). Cells were transfected at 70% confluence with an antisense oligonucleotide comprising sequences selected from SEQ ID NO: 3-26 at a final concentration of 10-500 nM using Lipofectamine RNAiMAX diluted in Opti-MEM (ThermoFisher). The antisense oligonucleotides contained non-complementary 5-mer sequences 5' and 3' of nucleotide sequences selected from SEQ ID NO: 3-26 and internucleotide linkages of the following pattern (5' to 3'): $R_S R_O R_S$-$R_O R_S D_S D_S D_S D_S D_S D_S D_S D_S D_S D_S R_O R_S R_O R_S$, wherein $R_S$ is an RNA (2'-MOE) phosphorothioate bond, $R_O$ is an RNA (2'-MOE) phosphodiester bond and $D_S$ is a DNA phosophorothioate bond. SARM1 siRNA (20 nM, Dharmacon) was used a positive control. All conditions were run in triplicate. Transfected cells were incubated for 24 to 72 hours and then harvested for RNA analysis. SARM1 transcript levels were evaluated using quantitative PCR carried out using TaqMan Real-Time PCR system (Thermo Fisher). SARM1 RNA levels were normalized to GAPDH (deltaCt) and plate-matched control transfected samples (delta-delta Ct), generating fold-change over control quantitation (2-(delta-deltaCt).

Results

Figure 2:
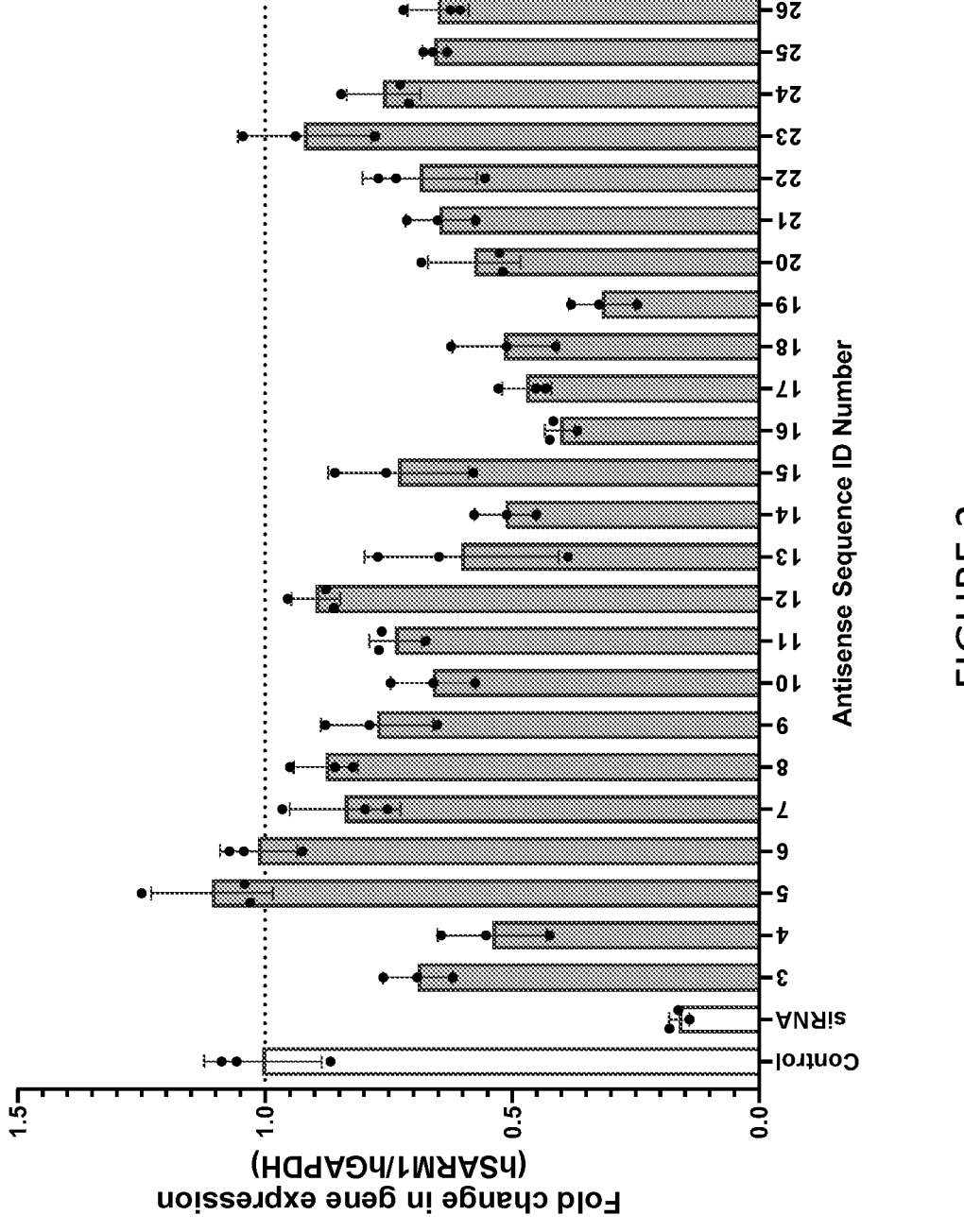
FIG. 2 shows a graph illustrating average fold-change in SARM1 gene expression in cells after transfection with SARM1 antisense oligonucleotides.

The average fold-change over the control transfected cells is plotted in FIG. 2 and a summary over the overall percent knockdown of SARM1 transcript is listed in Table 2.

TABLE 2

Percent knockdown of SARM1 transcript

| SEQ ID NO: | Average Percent Knockdown |
|---|---|
| 3 | 31 |
| 4 | 46 |
| 5 | 0 |
| 6 | 0 |
| 7 | 16 |
| 8 | 12 |
| 9 | 23 |
| 10 | 34 |
| 11 | 26 |

TABLE 2-continued

Percent knockdown of SARM1 transcript

| SEQ ID NO: | Average Percent Knockdown |
|---|---|
| 12 | 11 |
| 13 | 40 |
| 14 | 50 |
| 15 | 27 |
| 16 | 60 |
| 17 | 53 |
| 18 | 59 |
| 19 | 69 |
| 20 | 43 |
| 21 | 35 |
| 22 | 31 |
| 23 | 8 |
| 24 | 24 |
| 25 | 34 |
| 26 | 35 |

Specifically, SEQ ID NO:5 targeted the 5'UTR region, SEQ ID NOs: 4, 17, 18, 20 and 26 targeted the coding region and SEQ ID NOs: 13, 14, 16 and 19 targeted the 3'UTR. Surprisingly, some antisense oligonucleotide (ASO) sequences targeting different regions of the SARM1 transcript produced a robust knockdown of SARM1 expression compared to control, while other ASO sequences had little or no effect. Together, these results confirm that measurable knockdown of the SARM1 transcript can be produced by antisense targeting particular regions of the SARM1 mRNA sequence.

Example 2: Antisense Modulation of SARM1 Transcript in Human Neuroblastoma Cell Line This Example illustrates an in vitro assay used to characterize oligonucleotides. Antisense oligonucleotides complementary to different regions the SARM1 transcript were synthesized and tested for their ability to inhibit the SARM1 transcript in vitro in a human neuroblastoma cell line.

Human Neuroblastoma Cell Line

The human neuroblastoma cell line SH-SY5Y (ATCC-CRL-2266) was cultured in DMEM medium (Sigma-Aldrich) supplemented with 10% fetal bovine serum (Gibco) and 1 mM penicillin-streptomycin (Sigma). Cultures were plated at a density of 100,000 cells/well in a 24-well tissue culture plate coated with poly-D-Lysine (0.1 mg/ml; Sigma) and laminin (3 mg/ml; Invitrogen). Cells were allowed to adhere to the plates in a humidified tissue culture incubator (5% $CO_2$). Cells were transfected at 70% confluence with an antisense oligonucleotide selected from SEQ ID NO: 3-26 at a final concentration of 10-500 nM using Lipofectamine RNAiMAX diluted in Opti-MEM (ThermoFisher). The antisense oligonucleotides contained internucleotide linkages of the following pattern (5' to 3'): $R_S R_O R_S R_O R_S D_S D_S D_S$ $D_S D_S D_S D_S D_S D_S D_S R_O R_S R_O R_S$, wherein $R_S$ is an RNA (2'-MOE) phosphorothioate bond, $R_O$ is an RNA (2'-MOE) phosphodiester bond and $D_S$ is a DNA phosophorothioate bond. SARM1 siRNA (20 nM, Dharmacon) was used a positive control. All conditions were run in triplicate. Transfected cells were incubated for 24 to 72 hours and then harvested for RNA analysis. SARM1 transcript levels were evaluated using quantitative PCR carried out using TaqMan Real-Time PCR system (Thermo Fisher). SARM1 RNA levels were normalized to GAPDH (deltaCt) and plate-matched control transfected samples (delta-delta Ct), generating fold-change over control quantitation (2-(delta-deltaCt).

Results

Figure 3:
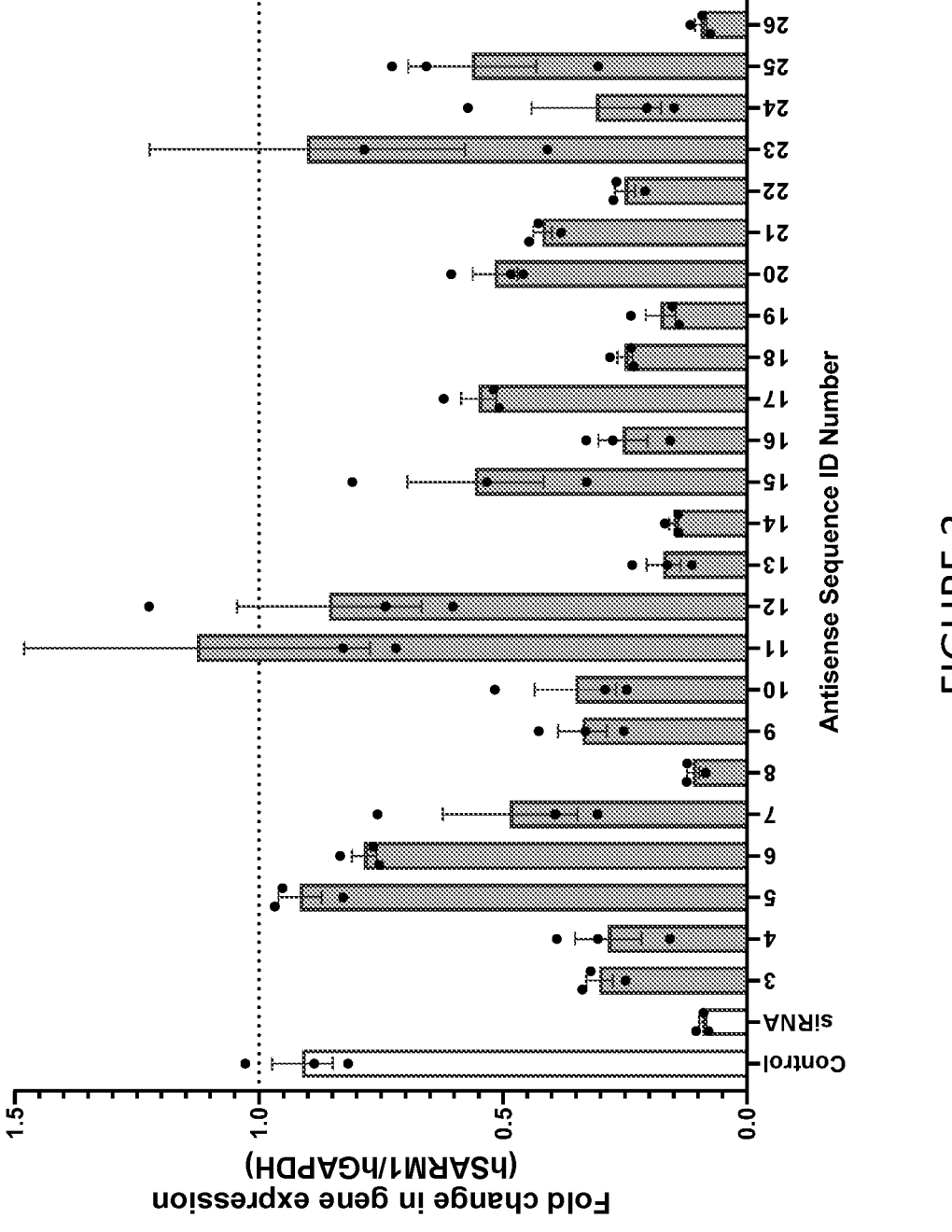
FIG. 3 shows a graph illustrating average fold-change in SARM1 gene expression in cells after transfection with SARM1 antisense oligonucleotides.

The average fold-change over the control transfected cells is plotted in FIG. 3. Specifically, SEQ ID NO:5 targeted the 5'UTR region, SEQ ID NOs: 4, 17, 18, 20 and 26 targeted the coding region and SEQ ID NOs: 13, 14, 16 and 19 targeted the 3'UTR. Surprisingly, some antisense oligonucleotide (ASO) sequences targeting different regions of the SARM1 transcript produced a robust knockdown of SARM1 expression compared to control, while other ASO sequences had little or no effect. Together, these results confirm that measurable knockdown of the SARM1 transcript can be produced by antisense targeting particular regions of the SARM1 mRNA sequence.

Example 3: Antisense Modulation of SARM1
Transcript in Human Motor Neurons

This Example illustrates robust concentration-dependent knockdown of SARM1 gene expression levels in vitro in human induced pluripotent stem cells (IPSC)-derived motor neurons following transfection with antisense oligonucleotides targeting the SARM1 transcript.

Human iPSC-derived motor neurons (Cellular Dynamics-R1049) were cultured and maintained according to the manufacturer's instructions for 14 days using iCell Complete Maintenance Medium plus DAPT (Cellular Dynamics). Motor neuron dispersed cultures were created by seeding 80,000 cells/well in a 24-well tissue culture plate coated with poly-D-Lysine (0.1 mg/ml; Sigma) and laminin (3 mg/ml; Invitrogen). Cells were transfected with 0.1, 0.3, 1, 3 or 10 nM of antisense oligonucleotides comprising SEQ ID NO: 9, 13, 22 or 38 using Lipofectamine RNAiMAX diluted in Opti-MEM (ThermoFisher). The antisense oligonucleotides contained internucleotide linkages of the following pattern (5' to 3'): $R_SR_OR_SR_OR_SD_SD_SD_SD_SD_SD_SD_SD_SD_SD_SR_OR_SR_OR_S$, wherein $R_S$ is an RNA (2'-MOE) phosphorothioate bond, $R_O$ is an RNA (2'-MOE) phosphodiester bond and $D_S$ is a DNA phosophorothioate bond. After 24 hours, a three-quarter medium change was performed to wash and remove the transfection solutions. At 48 hours, the cells were harvested and lysed for TaqMan RT-PCR analysis of SARM1 gene expression levels and normalized to Glyceraldehyde-3-Phosphate Dehydrogenase (GAPDH) gene expression levels. Results are shown in FIG. 4 and data (n=3) are expressed as mean±SEM and normalized to control-treated cells. FIG. 4 illustrates that for all four antisense oligonucleotides, as concentration increased, SARM1 expression in IPSC-derived motor neurons decreased.

Example 4: Antisense Modulation of SARM1
Transcript in Human Motor Neurons after Free
Uptake Delivery This Example illustrates robust concentration-dependent knockdown of SARM1 gene expression levels in vitro in human induced pluripotent stem cells (IPSC)-derived motor neurons following delivery by free uptake (i.e. in the absence of a lipid carrier) with antisense oligonucleotides targeting the SARM1 transcript.

Figure 5:
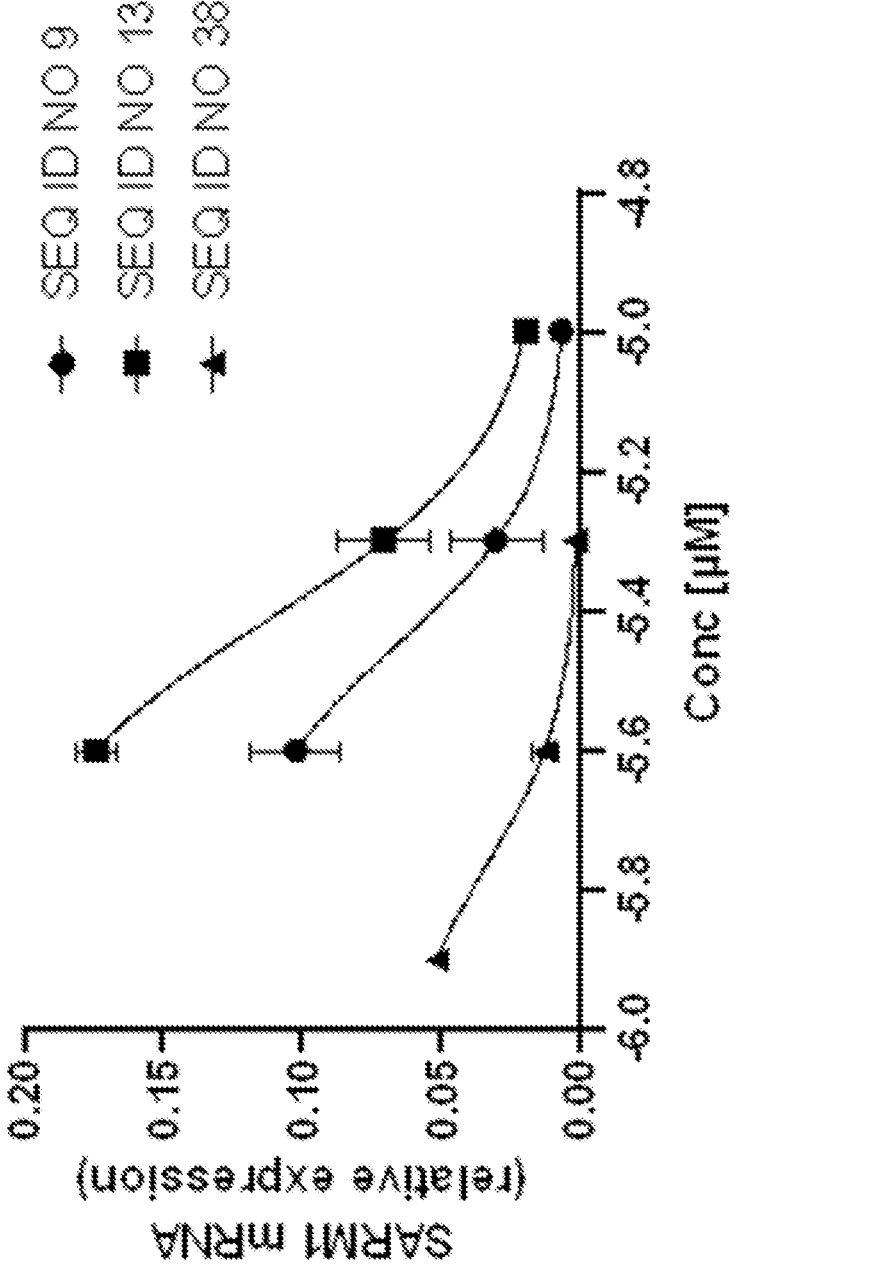
FIG. 5 shows a graph illustrating relative SARM1 mRNA expression in human induced pluripotent stem cells (IPSC)-derived motor neurons following delivery by free uptake (i.e. in the absence of a lipid carrier) with antisense oligonucleotides targeting the SARM1 transcript.

Human iPSC-derived motor neurons (Cellular Dynamics-R1049) were cultured and maintained according to the manufacturer's instructions for 14 days using iCell Complete Maintenance Medium plus DAPT (Cellular Dynamics). Motor neuron cultures were created by seeding 10,000 cells/well in a 96-well tissue culture plate coated with poly-D-Lysine (0.1 mg/ml; Sigma) and laminin (3 mg/ml; Invitrogen). Cells were allowed to adhere to the plates in a humidified tissue culture incubator (5% CO2) and then tissue culture wells were filled with 1 ml of cell culture media. Antisense oligonucleotides comprising SEQ ID NO: 9, 13 or 38 were diluted in Opti-MEM (ThermoFisher) at a concentration range of 1.25 to 10 UM and added to the cell culture media. The antisense oligonucleotides contained internucleotide linkages of the following pattern (5' to 3'): $R_SR_OR_SR_OR_SD_SD_SD_SD_SD_SD_SD_SD_SD_SD_SR_OR_SR_OR_S$, wherein $R_S$ is an RNA (2'-MOE) phosphorothioate bond, $R_O$ is an RNA (2'-MOE) phosphodiester bond and $D_S$ is a DNA phosophorothioate bond. After 9 days, cells were harvested and lysed for TaqMan RT-PCR analysis of SARM1 gene expression levels and normalized to Glyceraldehyde-3-Phosphate Dehydrogenase (GAPDH) gene expression levels. Results are shown in FIG. 5 and data (n=2) are expressed as mean±SEM and normalized to control-treated cells. FIG. 5 illustrates that for all three antisense oligonucleotides, as concentration increased, SARM1 expression in IPSC-derived motor neurons decreased.

Example 5: Time-Dependent Antisense Modulation
of SARM1 Transcript in Human Motor Neurons
After Free Uptake Delivery This Example illustrates time-dependent knockdown of SARM1 gene expression levels in vitro in human induced pluripotent stem cells (IPSC)-derived motor neurons following free uptake (no lipid carrier) delivery with antisense oligonucleotides targeting the SARM1 transcript.

Figure 6:
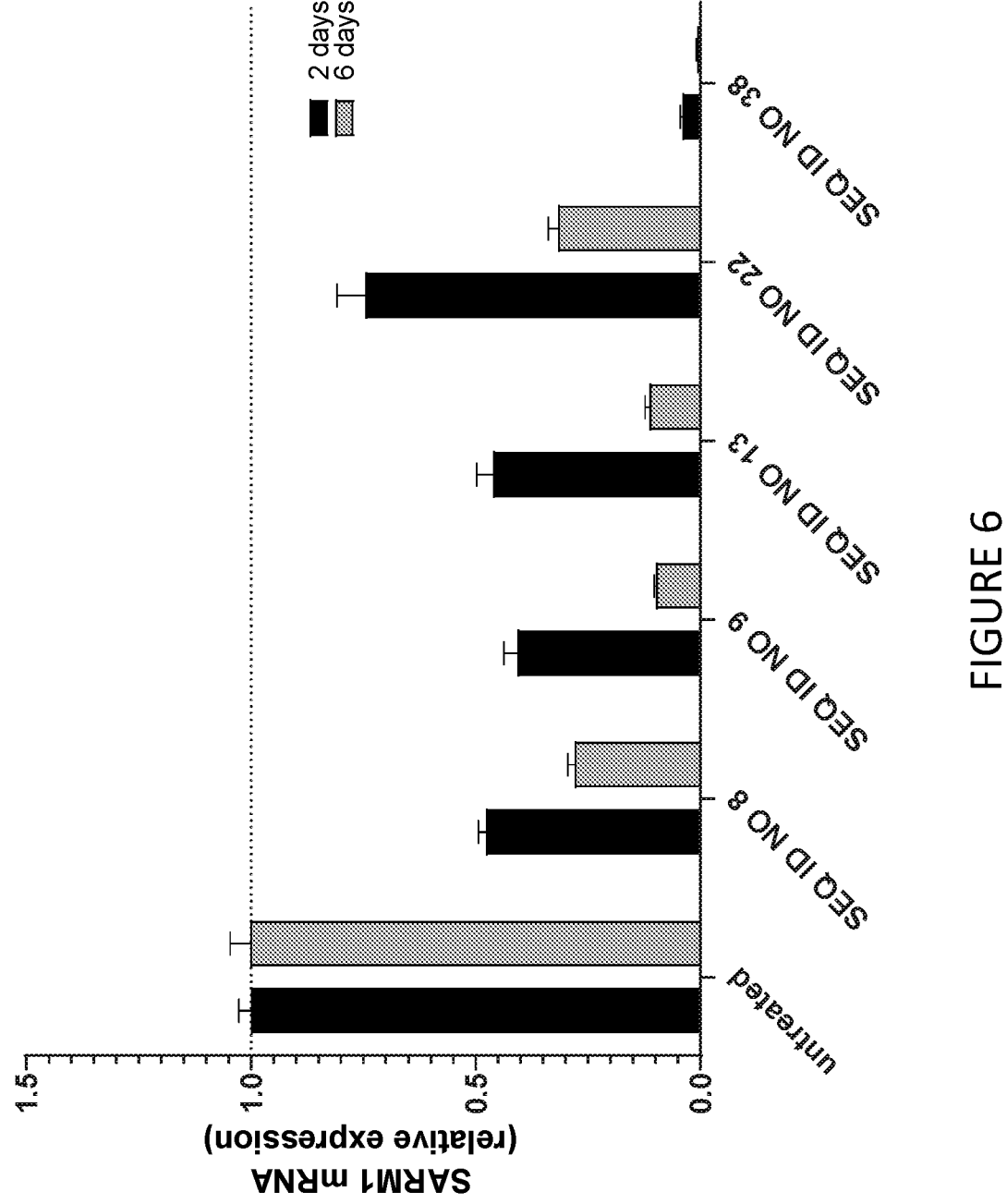
FIG. 6 shows a graph illustrating relative SARM1 mRNA expression in human induced pluripotent stem cells (IPSC)-derived motor neurons 2 days and 6 days following delivery by free uptake (i.e. in the absence of a lipid carrier) with antisense oligonucleotides targeting the SARM1 transcript.

Human iPSC-derived motor neurons (Cellular Dynamics-R1049) were cultured and maintained according to the manufacturer's instructions for 14 days using iCell Complete Maintenance Medium plus DAPT (Cellular Dynamics). Motor neuron cultures were created by seeding 80,000 cells/well as a spot in the center of each well of a 24-well tissue culture plate coated with poly-D-Lysine (0.1 mg/ml; Sigma) and laminin (3 mg/ml; Invitrogen). Cells were allowed to adhere to the plates in a humidified tissue culture incubator (5% CO2) and then tissue culture wells were filled with 1 ml of cell culture media. Antisense oligonucleotides comprising SEQ ID NO: 8, 9, 13, 22 or 38 were diluted in Opti-MEM (ThermoFisher) to a concentration of 10 UM and added to the cell culture media for free uptake delivery. The antisense oligonucleotides contained internucleotide linkages of the following pattern (5' to 3'): $R_SR_OR_SR_OR_S$ $D_SD_SD_SD_SD_SD_SD_SD_SD_SD_SR_OR_SR_OR_S$, wherein $R_S$ is an RNA (2'-MOE) phosphorothioate bond, Rois an RNA (2'-MOE) phosphodiester bond and $D_S$ is a DNA phosophorothioate bond. After 2- or 6-days, cells were harvested and lysed for TaqMan RT-PCR analysis of SARM1 gene expression levels and normalized to Glyceraldehyde-3-Phosphate Dehydrogenase (GAPDH) gene expression levels. Results are shown in FIG. 6 and data (n=3) expressed as mean±SEM and normalized to control-treated cells. FIG. 6 illustrates that for motor neurons treated with any of the five antisense oligonucleotides, SARM1 expression decreased at both time-points relative to the untreated control.

Example 6: SARM1 Antisense Prevents Axonal
Degeneration Following Axotomy in Human
iPSC-Derived Motor Neurons This Example illustrates that treatment with SARM1 antisense oligonucleotides prevented axonal degeneration following axotomy. Specifically, an in vitro axon degeneration assay was used to test the efficacy of oligonucleotides complementary to different regions the SARM1 transcript to prevent axonal degeneration in a human induced pluripotent stem cell (iPSC)-derived motor neuron drop culture.

Human Motor Neuron Drop Culture

Human iPSC-derived motor neurons (Cellular Dynamics-R1049) were cultured and maintained according to the manufacturer's instructions for 14 days using iCell Complete Maintenance Medium plus DAPT (Cellular Dynamics). Motor neuron drop cultures were created by seeding 10,000 cells/well as a spot in the center of each well of a 24-well tissue culture plate coated with poly-D-Lysine (0.1 mg/mL; Sigma) and laminin (3 mg/mL; Invitrogen). Cells were allowed to adhere to the plates in a humidified tissue culture incubator (5% CO2) and then tissue culture wells were filled with 1 ml of cell culture media. Antisense oligonucleotides comprising SEQ ID NO: 9, 22, 38 or 39 were diluted in Opti-MEM (ThermoFisher) to a 5 µM concentration and added to the cell culture media for free uptake delivery. The antisense oligonucleotides contained internucleotide linkages of the following pattern (5' to 3'): $R_S R_O R_S R_O R_S D_S D_S D_S D_S D_S D_S D_S D_S D_S D_S R_O R_S R_O R_S$, wherein $R_S$ is an RNA (2'-MOE) phosphorothioate bond, Rois an RNA (2'-MOE) phosphodiester bond and $D_S$ is a DNA phosophorothioate bond. 10 days post-transfection, the axonal degeneration assay was performed.

Axon Degeneration Assay

Figure 7:
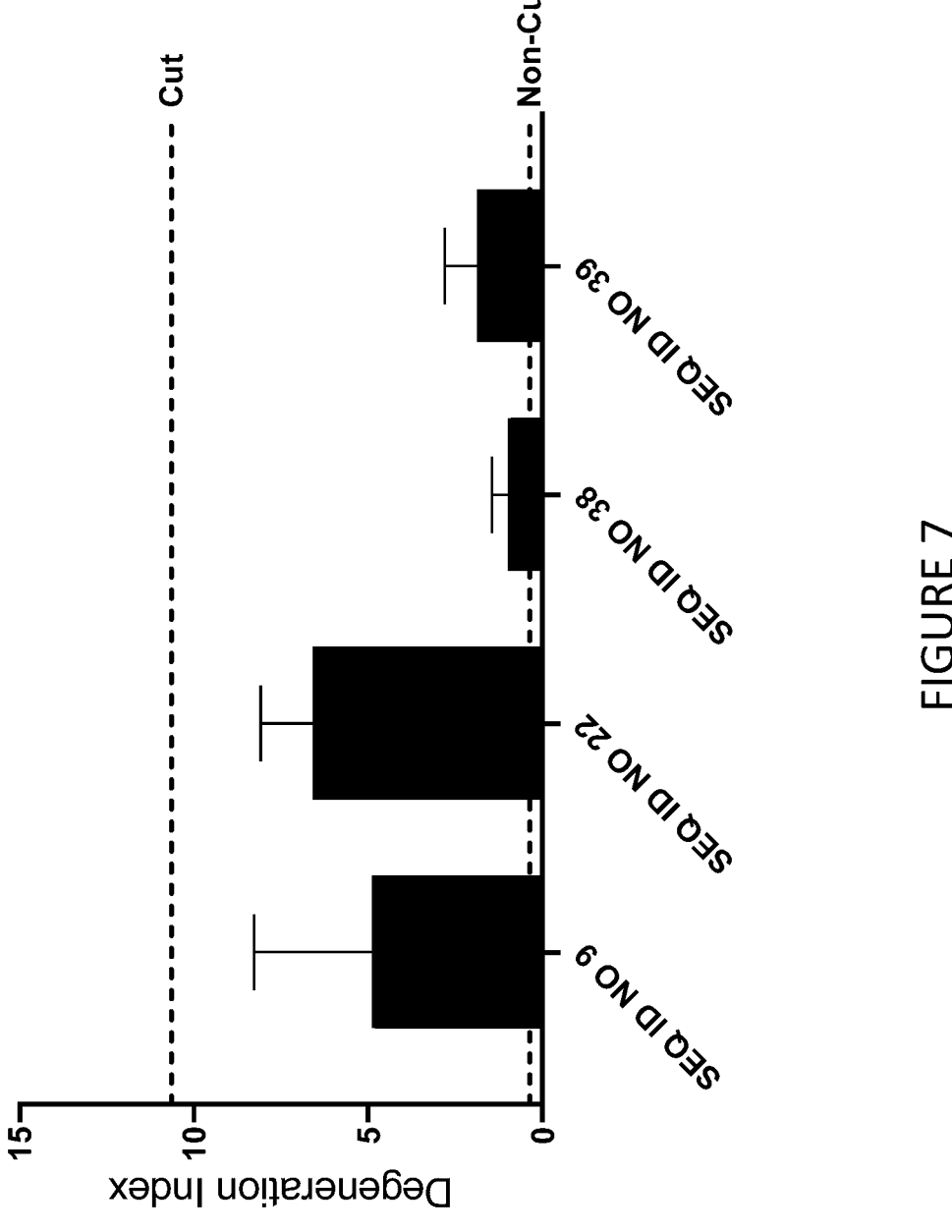
FIG. 7 shows a graph illustrating that SARM1 antisense oligonucleotides prevent axonal degeneration following axotomy in human iPSC-derived motor neurons treated using free uptake delivery.

Axonal degeneration was stimulated by manual axonal transection using a scalpel blade. After 16 hours, motor neuron cultures were fixed in 1% PFA plus sucrose and kept in the refrigerator prior to imaging. Cells were immuno-stained for beta-3 Tubulin (Clone TuJ1, R&D systems), images of motor neuron axons and cell bodies were collected using the 20× water immersion lens of a Phenix automated confocal microscope (PerkinElmer) and quantitation of axons was performed using in-house developed scripts (Acapella, PerkinElmer). The degeneration index reflects the integrity of the axon such that a higher value indicates a greater level of axonal fragmentation and a lower value indicates a lower level of axonal fragmentation. As shown in FIG. 7, ASOs that knock-down SARM1 expression reduced axonal degeneration in this assay. The data in FIG. 7 is expressed as mean±SEM (n=3-4). The dashed line labeled 'Cut' denotes mean level of degeneration observed in control-cut axons and dashed line labeled 'Non-Cut' denotes mean level of degeneration observed in intact control axons.

EXEMPLARY SEQUENCES

Wild-Type Human SARM1 Protein Sequence

```
MVLTLLLSAYKLCRFFAMSGPRPGAERLAVPGPDGGGGTGPWWAAGGRGPREVSPGAGTEVQDALERALPELQQAL
SALKQAGGARAVGAGLAEVFQLVEEAWLLPAVGREVAQGLCDAIRLDGGLDLLLRLLQAPELETRVQAARLLEQILVAE
NRDRVARIGLGVILNLAKEREPVELARSVAGILEHMFKHSEETCQRLVAAGGLDAVLYWCRRTDPALLRHCALALGNCA
LHGGQAVQRRMVEKRAAEWLFPLAFSKEDELLRLHACLAVAVLATNKEVEREVERSGTLALVEPLVASLDPGRFARCLV
DASDTSQGRGPDDLQRLVPLLDSNRLEAQCIGAFYLCAEAAIKSLOGKTKVFSDIGAIQSLKRLVSYSTNGTKSALAKRAL
RLLGEEVPRPILPSVPSWKEAEVQTWLQQIGFSKYCESFREQQVDGDLLLRLTEEELQTDLGMKSGITRKRFFRELTELKT
FANYSTCDRSNLADWLGSLDPRFRQYTYGLVSCGLDRSLLHRVSEQQLLEDCGIHLGVHRARILTAAREMLHSPLPCTG
GKPSGDTPDVFISYRRNSGSQLASLLKVHLQLHGFSVFIDVEKLEAGKFEDKLIQSVMGARNFVLVLSPGALDKCMQDH
DCKDWVHKEIVTALSCGKNIVPIIDGFEWPEPQVLPEDMQAVLTFNGIKWSHEYQEATIEKIIRFLOGRSSRDSSAGSDT
SLEGAAPMGPT (SEQ ID NO: 1).
```

Wild-type human SARM1 cDNA sequence (corresponding to mRNA sequence) (NCBI Accession Number: NM_15077.4) The target sequences of exemplary ASOs are denoted in bold capital letters and in the case where the sequences overlap it is denoted by underline. In the one instance where there is an overlap in ASO targeting, the sequence is denoted in both bold and underlined capital letters.

```
  1    atctcccagctcagccgagcccgtgcccaggccacgctttgttccagccgccgcctcctc 61    taccctacggcgtccggagccatccctcgcctgctcgctctctcctttcgcccactccct 121    gcatctgggcctgcatcacctttgccaaccgctccccgatcctgccgacactcctcccc 181    caaacttctgaccggcacccttgcctggtacccttctctccattcctccccctccatctt 241    ctttccccgacccctctcgggtccctcttttcccaaaacccgggtctctccgcgtggccc 301    cgcctccaggccggggatgtcccccgcggccccgcGCCCATGGTCCTGACGCTGCttctc 361    tccgcctacaagctgtgtcgcttcttcgccatgtcgggcccacggccgggcgccgagcgg 421    ctggcggtgcctgggccagatggggcggtggcacgggcccatggtgggctgcgggtggc 481    cgcgggccccgcgaagtgtcgccggggcaggcaccgaggtgcaggacgccctggagcgc 541    gcgctgccggagctgcagcaggccttgtccgcgctgaagcaggcgggcggcgcgcgggcc 601    gtgggcgccggcctggccgaggtctTCCAACTGGTGGAGGAGGCCtggctgctgccggcc 661    gtgggccgcgaggtagcccagggtctgtgcgacgccatccgcctcgatggcggcctcgac 721    ctgctgttgcggctgctgcaggcgccggagtTGGAGACGCGTGTGCAGGCCgcgcgcctg 781    ctggaGCAGATCCTGGTGGCTGAGAaccgagaccgcgtggcgcgcattgggctgggcgtg 841    atcctgaacctggcgaaggaacgcgaacccgtagagctggcgcgggagcgtggcaggcatc 901    ttggagcacatgttcaagcattcggaggagacatgccagaggctggtggcggccggcggc
```

```
 961  ctggacgcggtgctgtattggtgccgccgcacggaccccgcgctgctgcgccactgcgcg 1021  ctggcgctgggcaactgcgcgctgcacgggggccaggcggtgcagcgacgcatggtagag 1081  aagcgcgcagccgagtggctcttcccgctcgccttctccaaggaggacgagctgcttcgg 1141  ctgcacgcctgcctcgcagtagcggtgttggcgactaacaaggaggtggagcgcgaggtg 1201  gagcgctcgggcacgctggcgctcgtggagccgcttgtggcctcgctggaccctggccgc 1261  ttcgcccgctgtctggtggacgccagcgacacaagccagggccgcgggcccgacgacctg 1321  cagcgcctcgtgccgttgctcgactctaaccgcttggaggcgcagtgcatcggggctttc 1381  tacctctgcgccgaGGCTGCCATCAAGAGCCTGCaaggcaagaccaaggtgttcagcgac 1441  atcggcgccatcCAGAGCCTGAAACGCCTGGTttcctactctaccaatggcactaagtcg 1501  gcgctggccaagcgcgcgctgcGCCTGCTGGGCGAGGAGGTGccacggcccatcctgccc 1561  tccgtgcccagctggaaggaggccgaggttcagacgtggctgcagcagatcggtttctcc 1621  aagtactgcgagagcttccGGGAGCAGCAGGTGGATGGCgacctgcttctgcggctcACG 1681  GAGGAGGAACTCCAGACcgacctgggcatgaaatcgggcatcacccgcaAGAGGTTCTTT 1741  AGGGAGCTCacggagctcaagaccttcgccaactattctacgtgcgaccgcagcaacctg 1801  gcggactggctgggcagcctggacccgcgcttccgccagtacacctacggcctggtcagc 1861  tgcggcctGGACCGCTCCCTGCTGCACCgcgtgtctgagcagcagctgctggaagactgc 1921  ggcatccacctgggcgtgcaccgcgcccgcatcctcacggcggccagagaaatgctacac 1981  tccccgctgccctgtactGGTGGCAAACCCAGTGGGGAcactccagatgtcttcatcagc 2041  taccgccggaactcaggttcccagctggccagtctcctgaaggtgcacctgcagctgcat 2101  ggcttcagtgtcttcattgatgtggaGAAGCTGGAAGCAGGCAAGTtcgaggacaaactc 2161  atccagagtgtcatgggtgcccgcaactttgtgttggtgctatCACCTGGAGCACTGGAC 2221  AAGtgcatgcaagaccatgactgcaaggattgggtgcataaggagattgtgactgcttta 2281  agctgcggcaagaacattgtgcccatcattgatggcttcgagtggcctgagccccaggtc 2341  ctgccTGAGGACATGCAGGCTGTGCttactttcaacggtatcaagtggtcccacgaatac 2401  caggaggccaccattgagaagatcatccgcttcctgcagggccgctcctcccgggactca 2461  tctgcaggctctgacaccagtttggagggtgctgcacccatgggtccaacctaaccagtc 2521  cccagttccccagccctgctgtgacttccatttccatcgtcctttctgaaggaacagctc 2581  ctgaaaccagtc*TCCCTGGGCTGAGACAACCTGGG*ctcttcttaggaaatggctctccct 2641  cccccgtcccccaccctcatggcccacctccaacccactttcctcaGTATCTGGAGAGG 2701  GAAGGGAagtcaggcttgggcacgggaggttagaactcccccaggccctgccattgggtt 2761  gtctgtctccgtcatgggagggtccctgctcagttctggagacactggagtGGGGGTGG 2821  GGGTGGTTCTGCAttcccttctcctgctgatagcagtcagcttgaggaggatgacggaag 2881  gcagcctcagacaggaattaaggcaatgcccaggcgggcctgggcactgtaTTCTGAGCA 2941  AGGGCCTGGGCccaggaGCCAGCCAGGGATGAGTGCCatcatggctctccactcagactg 3001  tgcctggcccctgcacttacaacttcctgccgctctgtggccttgccctgtaatcactca 3061  gtgcccttagctagcctgactaagtcccagatcccctacagcttccttcggtgtggtatc 3121  tttTGCCACATCCAGGGCGAGGGttgaggcaaaccagccctccctctgacttccttgtca 3181  ctgcagccagctttgctgcacttgctggtgcacaggagcctcctgtttggGCCTGGGTCT 3241  GGGCATGGGGaggccgtgcctcaaagcccaccctacccatgccttggtgctgtgcctca
```

-continued

```
3301   ggctccttcctggtctggcccagctggcttccccagcccctcagccatccagggctaccc 3361   actgcttactcagggaccaggcagcccccatggcagtaaaagcagcctagacagaacctG 3421   CAGCTCTGTGGAAAGAGgcaaagtcctgaaaaggcaaagggttgtcacttagggcagctt 3481   ctccaactttaacatgcatccaagtcacctgggaatgttgttaaaatcaggagatctggg 3541   gtggggcctaggactctgcatttcttacagattcccaggtgagctgatgctggtggttaa 3601   gggtagcaaatctctaaagcacgaagccctcacaaatctttgccatttcccaaacactcc 3661   gctccatggtctccagtcatcagagcaactctacctggtattatcatccccattttacag 3721   ataatgacactgaggctcagaaaggttgaggataagcccactttcctgtcattagtggca 3781   gccccagatccagacctaggcctcctggcacccagtccactggcagtggaattgctttcc 3841   tgagaatcattctgaggctgggctattgcttctcccttgcttcaaagaatctagcagcgg 3901   gggataggattttgcaacaaaaagctgacccagaggccatacagagcaggaatatcccat 3961   tgccccctcctccactgggttcagagggtaagaaagcaccctccaataaacccaggctcc 4021   aggccgtgggggctgctgaaggctctttccccgcaagggccaggtgttgacaccttaaag 4081   ctggctgcgccccagccccactcttggctgtgctggccaggtgactcctagttcttggc 4141   cacatcatcagaaagtcaaaggtctcactccaggtttggggctccttccttccactcccc 4201   tccctgccagagtctgtcttggccagtgccagcctcgatgctttggttttgaccccacct 4261   gatcctcctttcctcatgcagcacaagtgctcaccggggccagagccagggcatggatat 4321   gacaagcagggcagcctggacactgccctcacaggacagcgccaataacaatacagtgtc 4381   tgagtatctccaggggatgatttctggctctttgtctccaatcagtcccactccctcctg 4441   aggtccccaagggcagtattcagagaggtttcctgcgttttatttctatttggtataccc 4501   tccactgttgtccactgccctgtgtggccttctggttgacctctgcccgatcttctgtct 4561   ctctgagggaatcagagtccagcatccagccccagctggaacagctgaagtcacaagcct 4621   cctctaagccaaggccagtgtgttcagaggtgactgccacccatactaggacaaacacag 4681   ctcagatcaccaggtcaagcacctaggcctggcttctcctgagacagaggactcagaagt 4741   ggcctttcctccaaagcctgctcagacacaggtctgtagggccaggtgttctgcttggc 4801   tgggctgcagctgctacccctcggttggggctgagtcagccagatcctcccctacttct 4861   ccccaagggccaagaactgctcagggacattaaaggtcaaaagtccagccacactcattc 4921   atcctttccccaggcccatgaagagaggcatctcattgtagaatgtatgaggaagtggga 4981   agtatctcagagaatcagctaagtttcctaacttgtccatccaaatgtgatcaccacgat 5041   tcaacaatttggggcattgctgatctagccgttcctagtggggcttgctcaaggttgcac 5101   agcgagtcagtagaagccctggctggccccacttggtaccaatccaccaggcagctcagg 5161   gctcctgcccagcccagcagcttctgttgtctaacgtatggcaggcagactgggagcagg 5221   aaaacagagggccccaaagcccaaggcaccagaaggtttgtttcagtttgctgaagctga 5281   tttgtaatgattggcactcttcagccaggggagtgggtaggccatagccaaggatcgatt 5341   ccccaaccacagcaaaggcaacactcttcctccagagatcaccaagcccctcttacctcc 5401   ctccctccttcccaaggctggcactaaccaggtaccacattcattgttaaggaatggctg 5461   atgactgctacacgtgttgggaacctggttggggctgtgcagtttgggctggaaggagag 5521   atgccagccctcgtgctgcctctggtccctgaagtgtcacctctctcaggacctctcctc 5581   tggcctgtggggttataagtgatggatagcagaaagggagaactgactcctgtcccaaat 5641   agctcctctgccacctgtcctgcagtgggcctgtgtgggttatgattctagatcctagac
```

-continued

```
5701   agaggctgggtcagctgtggatggggtggtgccttggtctctcttgactacctcgtccaa 5761   agagagcactgcccttagacaagagttgcttgtcctgctgtgggctgggcttccagctgc 5821   agacctccagttgcttggtgttcactttgctcctcttgccctctgtcttctggtccaggc 5881   agatcaggggctctggggaaactgctggaactcgaggtgaggatcagccttttccagcat 5941   cctgtgagagaccagagagagagtttggatttcatgtggggaaccctcaaggcctgtctg 6001   gagaagtgacacaggatttactggggtgggctggtccaggtagctctcctgaacctcctc 6061   cttccccaagctgagaagctgagagctggaggacaatatccagggacatggctctggaaa 6121   ataacttttttttttttaagagacagggtcttgctctgttgtccaggctggagggcagtg 6181   acataatcatagctcactgtacccttgaactcctgggctcaagtgatcctcctgcctcag 6241   cctccttagtagctgggactaccagtgcataccaccatgcctgggtgattttttaaattt 6301   tttatacagacaaggtcttgctatgttgcccaggctgatcttgaattcccgggctcaagt 6361   ggtcctcctgcctcagcctcccacaggatcgggattacaggcaagagcctccacgcccgg 6421   ccatgaaatataattcttaatatcatacaggaaaaagtcagcgggtcaagctagcctgtg 6481   gcccagccacaactagctgacaaagcttcctggccttcccttta acacagttctgctgcc 6541   atagttccatctataaaatgggaatggaggga aatagg ggaactgggagagagaacacag 6601   ccttgccaagcagcaatgttagcctgatccttcctccacctagctcgccatctcgccctt 6661   ggaaaatggctcctggaggattaggcagccatctgcaaggagaggggcaacctgggacaa 6721   gacacccagagggtaaggattccaggaatgaagctgccatttctggttgggaggagaaga 6781   ggaaacttttaagagaaagggctccattatgagcatgggttcagggccctgcattacccca 6841   atcagaacagccgggatgagcaggaggccagctcccaggaggaaggggaaccccttcata 6901   aagttcagagtggctgggtagagtgagttgaagatgccggaggccgtcagcatggccagg 6961   ctattcacacaggccacagcagaaaagagagcacctgtgaagaaataaataccatactct 7021   ggagtccgaaagggccatattccaactctggcaccaccacctcacagctgtgtgaccggg 7081   agtagtcacttaacctatgtctccccttcctcaccagtaaatcctgctacatcatgtact 7141   gtgacaaggattcagtaaggtcatatgtggacagtagctggcacagagggggctactaaac 7201   aaatggctgctattaaatccacattaaaagtacatgtgatctgacagaacccagcacata 7261   aaagaaaaaaaaagtacatgtgatattgtctgatgaaagcttgatggaaatggctttttt 7321   ctggtttatcctctttggaatcatctcctgtttgggattaactgctggtctgatcagttc 7381   caatattcatagcggtgtcaccactgaatagcttcttatcctttgggttcctgttcctcc 7441   ttctgctaaataaggataatacctatttcctagattgtgagcaacattaagttcacatgg 7501   aaatcacccatcactgggcctggtcccctggaagtagctagttagtaagggctgttcttt 7561   tctcctgtttctcttgacatctctgggcacagagaaagtgctgggaaaaaaagtttaggt 7621   gaatgaatgaagacacatggattctggggacaccagaacccacagtgggctctgtatggc 7681   accagagtctctgtcatcatcagatcctcattccaggacagatggaaaaagatgaatgtt 7741   tccagactggggcataaagacccagaggctggagaagctgttctttatagatataccagg 7801   agaacccacagtttacaaaatgtgcaacaacccaacagaagttgagattaaattctgtca 7861   catctagaggggtctgtgatgtcatcaaaagcaaaccacccacatcacagatgaagaaac 7921   aggcctgtggcagggctcggactaaaacccagatcctgagaccagctgcttttaaacaca 4981   gacgtaggtttgcatcctagctccaccatttactgagtaaccttgggtgagccaatgtaa
```

-continued

```
 8041   cccccctgggtctctgtttctttatctgtcaactgtggaaaatgaaacccatgtcacaagg 8101   ttgttcacttctgggcttgtacacgctgaccccagagaaacagggaactctggcatcacc 8161   acacccatcttacagacggaaaagctgaggtctgcagagagtaaatcctctgctctggtt 8221   atctagaaagaacataattgtgctctgctgactgcaaatcccaactctgcggtttgaaaa 8281   tccaaggtggcatgatcctctgcccattgtgggcaatttcacagaaatgtgtttgttttg 8341   gccacttacttctccagggtgagagggggggaaggcaagctgttcccccagccatggctgc 8401   ccatcagcccgtttcgggcagcactggacatgaggaaccagacacaggtgggttctgaca 8461   ctcaccctgctctgtctctctcaccagcttggagagtttagcccggatgacaggtgtgat 8521   gactaatgacaggaaaagcaacccatatcctgtggagaaacaaacactcatcaggaaaat 8581   ggggctggggagaggggcgtccaagggaaaggcagcagagctcctatccataccccacgt 8641   ggggcttaggttagacccaggaagaacttccttgatggtgagggtgggaagacagtagtc 8701   aaggaggaatggagactgcccttgtctgggcttggccacctgctagctctcatgaatgaa 8761   tgctaattcccattgattgctttcttgtctgaacctcttgtggtcacagcaggcatcacc 8821   cacccacttggcacttagtagggatatggcagggcacagaaaacaagcatgggctttgga 8881   gtcagccctgagttcaaaacctgatgccattacatattatctgtgtggcctggggtactt 8941   accctctctgatcctgactccctgtatgaggaagataataaggccttcatcacaggatgg 9001   ttctgaggcataggaggctgaataatggtgcccaatggcatcagattcatagccctggaa 9061   cctgtaaatactaccttatttggaaaatgagtctatgcaggtgtgcagttaagcctcctg 9121   agagagcagagttatcctggattaggttgggccctaaatgccgtcacacatatctttata 9181   agaggaaagcagacggagatttggcaccgacagaattgagaaggcacaaagaggaggaga 9241   gtcaatgtgagcacagaggcagagactggtgatggccgccccaagccaaggaatgccagc 9301   agccccagaagctggaagaaatgagaaacacgttctctcctggaggcttgcaagggagca 9361   ctgcctgctgactgcttccattcagcccggtggtactgactttggacttctggcctccag 9421   aactgtgagagaatatgtttctgttgtgttaagcccccaagtttgtggtatgtcattaca 9481   gcaatctcagggaaccaatacatgaggtaaaaaggtaacatctatgaagagcatggcata 9541   gggacacagcaaatgggagttcctttcccctttgcattcagttacttacaggcttcctgt 9601   tttcttcataaccatttctctccctgtgcgactgctgactcctcagcaaaactgcaaact 9661   cctacaggacagtggatcctccaaagaaggtatacgatgaggcatccagggaccctagca 9721   gtgtcaggcccctcaaatcccactctgttgagacctccccccgacccagagcaatgacag 9781   catctttatcatctctgcatcccccagggccatcagcaggagggaaaggttcccttctgc 9841   ttaattgtcagacaagcagttgagttaagaaatctgtgattattgtattgttgactatac 9901   acagcacattttagggctctatcaaaataaatctgtccctttaaaaaaagttaactaaag 9961   ccgggcacggtggctcatgcctgtaatcccaacactttgggaggctgaggcaggcggatc 10021   cttgagctcaggagttagagacctggactgggcaaaatggtgaggaccccatctctataa 10081   aaaatacaaaaattagcaaggtgtggtaatgtgcaccagtggtcccagctactagagagg 10141   ccaaggtgggaggatcatctgggcccgggggatgaggctgcagtgagccatgatcgtgcc 10201   actgcactctagcctgggtaacaaagcgagaccctgtctctaaatacatcaatcaaataa 10261   aaattttaaaaagttaa (SEQ ID NO: 2)
```

-continued

| Table 3-SARM1 antisense oligonucleotide sequences | |
|---|---|
| Antisense Oligonucleotide Sequence | SEQ ID NO: |
| GGCCTCCTCCACCAGTTGGA | 3 |
| GCAGGCTCTTGATGGCAGCC | 4 |
| GCCATCCACCTGCTGCTCCC | 5 |
| TCCCCACTGGGTTTGCCACC | 6 |
| ACTTGCCTGCTTCCAGCTTC | 7 |
| CTTGTCCAGTGCTCCAGGTG | 8 |
| GCACAGCCTGCATGTCCTCA | 9 |
| CCCAGGTTGTCTCAGCCCAG | 10 |
| TCCCTTCCCTCTCCAGATAC | 11 |
| TGCAGAACCACCCCCACCCC | 12 |
| GCCCAGGCCCTTGCTCAGAA | 13 |
| GGCACTCATCCCTGGCTGGC | 14 |
| CCCCATGCCCAGACCCAGGC | 15 |
| GCCTCTTTCCACAGAGCTGC | 16 |
| TCTCAGCCACCAGGATCTGC | 17 |
| GAGCTCCCTAAAGAACCTCT | 18 |
| CCAGGTTGTCTCAGCCCAGG | 19 |
| GGTGCAGCAGGGAGCGGTCC | 20 |
| GCAGCGTCAGGACCATGGGC | 21 |
| ACCAGGCGTTTCAGGCTCTG | 22 |
| CACCTCCTCGCCCAGCAGGC | 23 |
| GTCTGGAGTTCCTCCTCCGT | 24 |
| CCCTCGCCCTGGATGTGGCA | 25 |
| GGCCTGCACACGCGTCTCCA | 26 |
| ACTTGTCCAGTGCTCCAGGT | 27 |
| AGCACAGCCTGCATGTCCTC | 28 |
| GCCCAGGTTGTCTCAGCCCA | 29 |
| GCACTCATCCCTGGCTGGCT | 30 |
| ATGCCCAGACCCAGGCCCAA | 31 |
| AGGCTCTTGATGGCAGCCTC | 32 |
| TTCTCAGCCACCAGGATCTG | 33 |
| GGTTCTCAGCCACCAGGATC | 34 |
| GTGAGCTCCCTAAAGAACCT | 35 |
| TTGTCCAGTGCTCCAGGTGA | 36 |
| GGTTGTCTCAGCCCAGGGAG | 37 |
| AGGTTGTCTCAGCCCAGGGA | 38 |
| CAGGTTGTCTCAGCCCAGGG | 39 |
| CACTCATCCCTGGCTGGCTC | 40 |

-continued

```
TGGCACTCATCCCTGGCTGG                                       41

AGCTCCCTAAAGAACCTCTT                                       42

CTCCCTAAAGAACCTCTTGC                                       43

GCTCCCTAAAGAACCTCTTG                                       44

TGAGCTCCCTAAAGAACCTC                                       45

GTGCAGCAGGGAGCGGTCCA                                       46

CCAGGCGTTTCAGGCTCTGG                                       47

CAGGCGTTTCAGGCTCTGGA                                       48

CGGTTCTCAGCCACCAGGAT                                       49

AGGCGTTTCAGGCTCTGGAT                                       50

AACCAGGCGTTTCAGGCTCT                                       51

CCATCCACCTGCTGCTCCCG                                       52

TGGCACCTCCTCGCCCAGCA                                       53

GGTCGCCATCCACCTGCTGC                                       54

GTCGCCATCCACCTGCTGCT                                       55

CGCCATCCACCTGCTGCTCC                                       56

ATCCACCTGCTGCTCCCGGA                                       57

TCGCCATCCACCTGCTGCTC                                       58

CATCCACCTGCTGCTCCCGG                                       59

GTGGCACCTCCTCGCCCAGC                                       60

GGTCGGTCTGGAGTTCCTCC                                       61

GTCGGTCTGGAGTTCCTCCT                                       62

ACCCTCGCCCTGGATGTGGC                                       63

GAGTTCCTCCTCCGTGAGCC                                       64

GGTCTGGAGTTCCTCCTCCG                                       65

CGGTCTGGAGTTCCTCCTCC                                       66

GGAGTTCCTCCTCCGTGAGC                                       67

TGCAGCAGGGAGCGGTCCAG                                       68

AGCAGCGTCAGGACCATGGG                                       69

GAACCTCTTGCGGGTGATGC                                       70

AAACCAGGCGTTTCAGGCTC                                       71

GAAACCAGGCGTTTCAGGCT                                       72

AGAACCTCTTGCGGGTGATG                                       73

AAGAACCTCTTGCGGGTGAT                                       74

CCCTAAAGAACCTCTTGCGG                                       75

TCCCTAAAGAACCTCTTGCG                                       76

CCTAAAGAACCTCTTGCGGG                                       77

CTAAAGAACCTCTTGCGGGT                                       78

TAAAGAACCTCTTGCGGGTG                                       79
```

-continued

| | |
|---|---|
| GCCCACGGCCGGCAGCAGCC | 80 |
| GCGGTGCAGCAGGGAGCGGT | 81 |
| CCACGGCCGGCAGCAGCCAG | 82 |
| CACGGCCGGCAGCAGCCAGG | 83 |
| CGGTGCAGCAGGGAGCGGTC | 84 |
| CACGCGGTGCAGCAGGGAGC | 85 |
| AGCGTCAGGACCATGGGCGC | 86 |
| GACACGCGGTGCAGCAGGGA | 87 |
| GCCCCGATGCACTGCGCCTC | 88 |
| CCCCGATGCACTGCGCCTCC | 89 |
| GCCCGTGCCACCGCCCCCAT | 90 |
| TTCCTCCTCCGTGAGCCGCA | 91 |
| TCCTCCTCCGTGAGCCGCAG | 92 |
| AGCCCCGATGCACTGCGCCT | 93 |
| CCTCCTCCGTGAGCCGCAGA | 94 |
| CCCACGGCCGGCAGCAGCCA | 95 |
| ACGGCCGGCAGCAGCCAGGC | 96 |
| CAGCGTCAGGACCATGGGCG | 97 |
| ACACGCGGTGCAGCAGGGAG | 98 |
| TAGGTGTACTGGCGGAAGCG | 99 |
| GGGTCCAGGCTGCCCAGCCA | 100 |
| GTCCAGGCTGCCCAGCCAGT | 101 |
| GGTCCAGGCTGCCCAGCCAG | 102 |
| GTCCAGGCTGCCCTGCTTGT | 103 |
| TCCAGGCTGCCCTGCTTGTC | 104 |
| CCATGGGTGCAGCACCCTCC | 105 |
| GGTCTTGCCTTGCAGGCTCT | 106 |
| CCTGTCTGAGGCTGCCTTCC | 107 |
| AGGCCTCCTCCACCAGTTGG | 108 |
| ACTGAGCAGGGACCCTCCCC | 109 |
| CCCCACTGGGTTTGCCACCA | 110 |
| CAGCCTGCATGTCCTCAGGC | 111 |
| TCCTGTCTGAGGCTGCCTTC | 112 |
| TGGTCTTGCCTTGCAGGCTC | 113 |
| GTCTTGCCTTGCAGGCTCTT | 114 |
| CAGGCTGCCCTGCTTGTCAT | 115 |
| GGGTACCAGGCAAGGGTGCC | 116 |
| GCATGTCCTCAGGCAGGACC | 117 |
| CAGGAGGCTCCTGTGCACCA | 118 |
| GCACAGACCCTGGGCTACCT | 119 |

-continued

| | |
|---|---|
| ACAGGAGGCTCCTGTGCACC | 120 |
| TTCCTGTCTGAGGCTGCCTT | 121 |
| TTGGTCTTGCCTTGCAGGCT | 122 |
| CTTGGTCTTGCCTTGCAGGC | 123 |
| AGGAGGCTCCTGTGCACCAG | 124 |
| GCACTTGTCCAGTGCTCCAG | 125 |
| GCTCCTGTGCACCAGCAAGT | 126 |
| CCCACTGGGTTTGCCACCAG | 127 |
| GAGGTGGGCCATGAGGGTGG | 128 |
| GGAGGTGGGCCATGAGGGTG | 129 |
| TGGAGGTGGGCCATGAGGGT | 130 |
| CCACTGGGTTTGCCACCAGT | 131 |
| TGCACTTGTCCAGTGCTCCA | 132 |
| CCTTGGTCTTGCCTTGCAGG | 133 |
| GATGGCACTCATCCCTGGCT | 134 |
| GCCCAGACCCAGGCCCAAAC | 135 |
| CAGGCTCTTGATGGCAGCCT | 136 |
| GGCTCCTGTGCACCAGCAAG | 137 |
| AGGCTCCTGTGCACCAGCAA | 138 |
| ACAGCCTGCATGTCCTCAGG | 139 |
| TGCCCAGACCCAGGCCCAAA | 140 |
| GCATGCACTTGTCCAGTGCT | 141 |
| CATGTCCTCAGGCAGGACCT | 142 |
| ATGCACTTGTCCAGTGCTCC | 143 |
| CCCAGGCCCTTGCTCAGAAT | 144 |
| GGCCAGACCAGGAAGGAGCC | 145 |
| CACAGACCCTGGGCTACCTC | 146 |
| CTGGTGTCAGAGCCTGCAGA | 147 |
| AGGGTACCAGGCAAGGGTGC | 148 |
| GGCCCAAACAGGAGGCTCCT | 149 |
| AGAGCCTGCAGATGAGTCCC | 150 |
| ATGGCACTCATCCCTGGCTG | 151 |
| TCTTGCCTTGCAGGCTCTTG | 152 |
| AACTGAGCAGGGACCCTCCC | 153 |
| CCTTGCAGGCTCTTGATGGC | 154 |
| GCCTTGCAGGCTCTTGATGG | 155 |
| TCCTGTGCACCAGCAAGTGC | 156 |
| TGCAGGCTCTTGATGGCAGC | 157 |
| GCCATGATGGCACTCATCCC | 158 |

-continued

| | |
|---|---|
| GCCAGACCAGGAAGGAGCCT | 159 |
| CTTGCCTTGCAGGCTCTTGA | 160 |
| GTGCACCAGCAAGTGCAGCA | 161 |
| TCCACAGAGCTGCAGGTTCT | 162 |
| ACTGGTGTCAGAGCCTGCAG | 163 |
| TGATGGCACTCATCCCTGGC | 164 |
| CACAGCCTGCATGTCCTCAG | 165 |
| GGGCCAGACCAGGAAGGAGC | 166 |
| TGCATGTCCTCAGGCAGGAC | 167 |
| CCTGTGCACCAGCAAGTGCA | 168 |
| GCCTGGGTTTATTGGAGGGT | 169 |
| CCTCTTTCCACAGAGCTGCA | 170 |
| GGGTGCAGCACCCTCCAAAC | 171 |
| GGTTTGCCACCAGTACAGGG | 172 |
| GGGTTTGCCACCAGTACAGG | 173 |
| GCCAGCACAGCCAAGAGTGG | 174 |
| GGCCAGCACAGCCAAGAGTG | 175 |
| TGGCCAGCACAGCCAAGAGT | 176 |
| AGGCCCAAACAGGAGGCTCC | 177 |
| GAACTTGCCTGCTTCCAGCT | 178 |
| GGGCACCCATGACACTCTGG | 179 |
| AAGCACAGCCTGCATGTCCT | 180 |
| GCAGCACCCTCCAAACTGGT | 181 |
| GGTGCAGCACCCTCCAAACT | 182 |
| CCCTCTGAACCCAGTGGAGG | 183 |
| TGTGCACCAGCAAGTGCAGC | 184 |
| CTTTCCACAGAGCTGCAGGT | 185 |
| GGTGTCAGAGCCTGCAGATG | 186 |
| TGGTGTCAGAGCCTGCAGAT | 187 |
| CCAGGCCCAAACAGGAGGCT | 188 |
| AGTGTAGCATTTCTCTGGCC | 189 |
| ACAGAGCTGCAGGTTCTGTC | 190 |
| CATGCACTTGTCCAGTGCTC | 191 |
| TTCCACAGAGCTGCAGGTTC | 192 |
| GAACTGAGCAGGGACCCTCC | 193 |
| CTGGGTTTGCCACCAGTACA | 194 |
| CACTGGGTTTGCCACCAGTA | 195 |
| GTGCAGCAAAGCTGGCTGCA | 196 |
| AACTTGCCTGCTTCCAGCTT | 197 |
| TTGCCTTGCAGGCTCTTGAT | 198 |

-continued

| | |
|---|---|
| GCACCCTCCAAACTGGTGTC | 199 |
| CCACAGAGCTGCAGGTTCTG | 200 |
| GCCTGAGGCACAGCACCAAG | 201 |
| GCCCAAACAGGAGGCTCCTG | 202 |
| CAGAGCCTGCAGATGAGTCC | 203 |
| CCATGATGGCACTCATCCCT | 204 |
| CTCCTGTGCACCAGCAAGTG | 205 |
| GAAGAGCCCAGGTTGTCTCA | 206 |
| CTTGCAGGCTCTTGATGGCA | 207 |
| GGCACCCATGACACTCTGGA | 208 |
| GTCAGAGCCTGCAGATGAGT | 209 |
| TCAGGACTTTGCCTCTTTCC | 210 |
| ACAGACTCTGGCAGGGAGGG | 211 |
| ACTGGGTTTGCCACCAGTAC | 212 |
| GGAAGTCACAGCAGGGCTGG | 213 |
| TGCCTTGCAGGCTCTTGATG | 214 |
| CCAGCACAGCCAAGAGTGGG | 215 |
| GGACTTTGCCTCTTTCCACA | 216 |
| GCTGCTTTTACTGCCATGGG | 217 |
| AGTGCAGCAAAGCTGGCTGC | 218 |
| GTGTCAGAGCCTGCAGATGA | 219 |
| CAGGACTTTGCCTCTTTCCA | 220 |
| GGCACAGCACCAAGGCATGG | 221 |
| GGGAATGCAGAACCACCCCC | 222 |
| CCAGGCCCTTGCTCAGAATA | 223 |
| CTGAGGCACAGCACCAAGGC | 224 |
| AACAGGAGGCTCCTGTGCAC | 225 |
| AGAAGAGCCCAGGTTGTCTC | 226 |
| TTTCCACAGAGCTGCAGGTT | 227 |
| TGCCTTTTCAGGACTTTGCC | 228 |
| AGCCATGATGGCACTCATCC | 229 |
| TCTTTCCACAGAGCTGCAGG | 230 |
| AGCACCCTCCAAACTGGTGT | 231 |
| AAGAGCCCAGGTTGTCTCAG | 232 |
| CAGGCCCAAACAGGAGGCTC | 233 |
| CCTCCACCAGTTGGAAGACC | 234 |
| ACCCAGGCCCAAACAGGAGG | 235 |
| CCTCTGAACCCAGTGGAGGA | 236 |
| AGGACTTTGCCTCTTTCCAC | 237 |

-continued

| | |
|---|---|
| TCCCTCTCCAGATACTGAGG | 238 |
| TGGGTTTGCCACCAGTACAG | 239 |
| CAGAATACAGTGCCCAGGCC | 240 |
| TAAGCACAGCCTGCATGTCC | 241 |
| CCTGAGGCACAGCACCAAGG | 242 |
| CCTTTTCAGGACTTTGCCTC | 243 |
| AGCCTGGGTTTATTGGAGGG | 244 |
| CTGTGCACCAGCAAGTGCAG | 245 |
| GAGGCACAGCACCAAGGCAT | 246 |
| CCAGACCCAGGCCCAAACAG | 247 |
| GGCCAAGACAGACTCTGGCA | 248 |
| GTGCAGCACCTCCAAACTG | 249 |
| CCCTCTCCAGATACTGAGGA | 250 |
| GCCTGGGCATTGCCTTAATT | 251 |
| TGAGGCACAGCACCAAGGCA | 252 |
| CTCTTTCCACAGAGCTGCAG | 253 |
| GTAAGCACAGCCTGCATGTC | 254 |
| CTCCTTATGCACCCAATCCT | 255 |
| AATGCAGAACCACCCCCACC | 256 |
| GCCCAGCCTCAGAATGATTC | 257 |
| TTGCAGGCTCTTGATGGCAG | 258 |
| GCCCCAAACCTGGAGTGAGA | 259 |
| GAGTGGAAGGAAGGAGCCCC | 260 |
| GAGTGTAGCATTTCTCTGGC | 261 |
| TCAGAGCCTGCAGATGAGTC | 262 |
| TCTCCTTATGCACCCAATCC | 263 |
| GGAATGCAGAACCACCCCCA | 264 |
| AGTGGAAGGAAGGAGCCCCA | 265 |
| CCCAATCCTTGCAGTCATGG | 266 |
| ATGATGGCACTCATCCCTGG | 267 |
| TGCAGCACCTCCAAACTGG | 268 |
| GACCCAGGCCCAAACAGGAG | 269 |
| AGACCCAGGCCCAAACAGGA | 270 |
| GTCTCCAGAACTGAGCAGGG | 271 |
| TGGTTAGGTTGGACCCATGG | 272 |
| GAAGGGTACCAGGCAAGGGT | 273 |
| CAGACCCAGGCCCAAACAGG | 274 |
| GCACCCATGACACTCTGGAT | 275 |
| ACTTTGCCTCTTTCCACAGA | 276 |
| GACTTTGCCTCTTTCCACAG | 277 |

-continued

| AGCCCCAAACCTGGAGTGAG | 278 |
| CACCCAATCCTTGCAGTCAT | 279 |
| CTCCACCAGTTGGAAGACCT | 280 |
| CACCCTCCAAACTGGTGTCA | 281 |
| AGAACTGAGCAGGGACCCTC | 282 |
| TGGCCAAGACAGACTCTGGC | 283 |
| GGAGTGGAAGGAAGGAGCCC | 284 |
| CTGAACCCAGTGGAGGAGGG | 285 |
| CCCTCCAAACTGGTGTCAGA | 286 |
| AGGCACAGCACCAAGGCATG | 287 |
| CTTTGCCTCTTTCCACAGAG | 288 |
| GCCCTTGCTCAGAATACAGT | 289 |
| CTGGTTAGGTTGGACCCATG | 290 |
| TGGAAGTCACAGCAGGGCTG | 291 |
| AGCCCAGCCTCAGAATGATT | 292 |
| AGTAAGCACAGCCTGCATGT | 293 |
| TCCACCAGTTGGAAGACCTC | 294 |
| TCCTCCACCAGTTGGAAGAC | 295 |
| CAGCACCCTCCAAACTGGTG | 296 |
| TGGCAAAGGTGATGCAGGCC | 297 |
| GTGCCATTGGTAGAGTAGGA | 298 |
| TCCTTATGCACCCAATCCTT | 299 |
| GAGCCATGATGGCACTCATC | 300 |
| CAGAACTGAGCAGGGACCCT | 301 |
| GGAAGGAGCCCCAAACCTGG | 302 |
| GTGATTACAGGGCAAGGCCA | 303 |
| TCAGAATACAGTGCCCAGGC | 304 |
| GGCATTGCCTTAATTCCTGT | 305 |
| TGCACCAGCAAGTGCAGCAA | 306 |
| TTCCCTCTCCAGATACTGAG | 307 |
| TTCAGGACTTTGCCTCTTTC | 308 |
| GCAAGTGCAGCAAAGCTGGC | 309 |
| TCCAGAACTGAGCAGGGACC | 310 |
| CATGATGGCACTCATCCCTG | 311 |
| ACCCTCCAAACTGGTGTCAG | 312 |
| CCAAACTGGTGTCAGAGCCT | 313 |
| AGGGAATGCAGAACCACCCC | 314 |
| GGCCCTTGCTCAGAATACAG | 315 |
| AGGCCCTTGCTCAGAATACA | 316 |

-continued

| | |
|---|---|
| CAGGCCCTTGCTCAGAATAC | 317 |
| AAACAGGAGGCTCCTGTGCA | 318 |
| GGAGTGTAGCATTTCTCTGG | 319 |
| GGGAGTGTAGCATTTCTCTG | 320 |
| GAATGCAGAACCACCCCCAC | 321 |
| TGTCAGAGCCTGCAGATGAG | 322 |
| TCTGAACCCAGTGGAGGAGG | 323 |
| AGACAGACTCTGGCAGGGAG | 324 |
| GCCAAGACAGACTCTGGCAG | 325 |
| GCTCAGAATACAGTGCCCAG | 326 |
| GGGAGTGGAAGGAAGGAGCC | 327 |
| TAGCCCAGCCTCAGAATGAT | 328 |
| ATAGCCCAGCCTCAGAATGA | 329 |
| TCCAAACTGGTGTCAGAGCC | 330 |
| ACCCAATCCTTGCAGTCATG | 331 |
| CCCAGCCTCAGAATGATTCT | 332 |
| CCTTAATTCCTGTCTGAGGC | 333 |
| GCCTTAATTCCTGTCTGAGG | 334 |
| AGTGATTACAGGGCAAGGCC | 335 |
| CCTGGGCATTGCCTTAATTC | 336 |
| TTGCCTTTTCAGGACTTTGC | 337 |
| CTTATGCACCCAATCCTTGC | 338 |
| AGTGCCATTGGTAGAGTAGG | 339 |
| CCAAACAGGAGGCTCCTGTG | 340 |
| AAACTGGTGTCAGAGCCTGC | 341 |
| TCTCCAGAACTGAGCAGGGA | 342 |
| AGACAACCCAATGGCAGGGC | 343 |
| GAAGGAGCCCCAAACCTGGA | 344 |
| GTGGAAGGAAGGAGCCCCAA | 345 |
| GCATTGCCTTAATTCCTGTC | 346 |
| CTCTGAACCCAGTGGAGGAG | 347 |
| AGAGCCATGATGGCACTCAT | 348 |
| GATTACAGGGCAAGGCCACA | 349 |
| GCACTGAGTGATTACAGGGC | 350 |
| CCTTATGCACCCAATCCTTG | 351 |
| TTTCAGGACTTTGCCTCTTT | 352 |
| CTTAGTGCCATTGGTAGAGT | 353 |
| AAGAAGAGCCCAGGTTGTCT | 354 |
| TTATGCACCCAATCCTTGCA | 355 |
| CTGGCCAAGACAGACTCTGG | 356 |

-continued

| | |
|---|---|
| TTGCTCAGAATACAGTGCCC | 357 |
| TATGCACCCAATCCTTGCAG | 358 |
| TGTCTCCAGAACTGAGCAGG | 359 |
| CCAGCAAGTGCAGCAAAGCT | 360 |
| CTCCAGAACTGAGCAGGGAC | 361 |
| AAGGAGCCCCAAACCTGGAG | 362 |
| AGGAAGGAGCCCCAAACCTG | 363 |
| ACAATCTCCTTATGCACCCA | 364 |
| CACAATCTCCTTATGCACCC | 365 |
| AGAAGGGTACCAGGCAAGGG | 366 |
| CCAAGACAGACTCTGGCAGG | 367 |
| CTCAGAATACAGTGCCCAGG | 368 |
| ATCTCCTTATGCACCCAATC | 369 |
| GCACCAGCAAGTGCAGCAAA | 370 |
| CTCCAAACTGGTGTCAGAGC | 371 |
| CAAGTGCAGCAAAGCTGGCT | 372 |
| AAGGAAGTCAGAGGGAGGGC | 373 |
| CTTAATTCCTGTCTGAGGCT | 374 |
| TGATTACAGGGCAAGGCCAC | 375 |
| GCTTTAGAGATTTGCTACCC | 376 |
| CCAGCTTCTCCACATCAATG | 377 |
| CCAGCCTCAGAATGATTCTC | 378 |
| CCTCCAAACTGGTGTCAGAG | 379 |
| GGCACTGAGTGATTACAGGG | 380 |
| GGGCACTGAGTGATTACAGG | 381 |
| TTGGCAAAGGTGATGCAGGC | 382 |
| AAGACAGACTCTGGCAGGGA | 383 |
| ACCAGCAAGTGCAGCAAAGC | 384 |
| GCCCTGGATGTGGCAAAAGA | 385 |
| GAGTGATTACAGGGCAAGGC | 386 |
| GACTTAGTGCCATTGGTAGA | 387 |
| CAAGACAGACTCTGGCAGGG | 388 |
| ACCCATGACACTCTGGATGA | 389 |
| GAGAAGGGTACCAGGCAAGG | 390 |
| CACCCATGACACTCTGGATG | 391 |
| CATTGCCTTAATTCCTGTCT | 392 |
| CTTGCTCAGAATACAGTGCC | 393 |
| CCTTGCTCAGAATACAGTGC | 394 |
| CCCATGACACTCTGGATGAG | 395 |

-continued

```
ACTGGCCAAGACAGACTCTG                                     396

AAGTGCAGCAAAGCTGGCTG                                     397

CAGACAACCCAATGGCAGGG                                     398

AAGGAAGGAGCCCCAAACCT                                     399

GCCTCAGAATGATTCTCAGG                                     400

CCCTTGCTCAGAATACAGTG                                     401

CAAACTGGTGTCAGAGCCTG                                     402

GTTGGCAAAGGTGATGCAGG                                     403

GGTTGGCAAAGGTGATGCAG                                     404

TAAGAAGAGCCCAGGTTGTC                                     405

TCACAATCTCCTTATGCACC                                     406

CCTCTCCAGATACTGAGGAA                                     407

AGCAAGTGCAGCAAAGCTGG                                     408

TTAGTGCCATTGGTAGAGTA                                     409

ACTTAGTGCCATTGGTAGAG                                     410

TAGTGCCATTGGTAGAGTAG                                     411

GAAGGAAGGAGCCCCAAACC                                     412

GGTAGAGTAGGAAACCAGGC                                     413

CACTGAGTGATTACAGGGCA                                     414

GAGAGAAGGGTACCAGGCAA                                     415

CAATCTCCTTATGCACCCAA                                     416

GCTGTTCCTTCAGAAAGGAC                                     417

GTCACAATCTCCTTATGCAC                                     418

TTTGCCTTTTCAGGACTTTG                                     419

ACACTCTGGATGAGTTTGTC                                     420

AGCTGTTCCTTCAGAAAGGA                                     421

CTTTAGAGATTTGCTACCCT                                     422

CAGCTTCTCCACATCAATGA                                     423

GACACTCTGGATGAGTTTGT                                     424

AAGTAAGCACAGCCTGCATG                                     425

CAGCCTCAGAATGATTCTCA                                     426

GGAAGGAAGGAGCCCCAAAC                                     427

AGGGCACTGAGTGATTACAG                                     428

TGCCATTGGTAGAGTAGGAA                                     429

CAAGGAAGTCAGAGGGAGGG                                     430

AGAGAAGGGTACCAGGCAAG                                     431

ACAGACAACCCAATGGCAGG                                     432

AAGGGAATGCAGAACCACCC                                     433

AATCTCCTTATGCACCCAAT                                     434

GCAGGAAGTTGTAAGTGCAG                                     435
```

AGGAAGTTGTAAGTGCAGGG                                                436

AGCCTCAGAATGATTCTCAG                                                437

TTTAGAGATTTGCTACCCTT                                                438

TGCTTTAGAGATTTGCTACC                                                439

GAGACAGACAACCCAATGGC                                                440

GACAGACAACCCAATGGCAG                                                441

AGACAGACAACCCAATGGCA                                                442

AAAGTAAGCACAGCCTGCAT                                                443

CATGACACTCTGGATGAGTT                                                444

TGAGTGATTACAGGGCAAGG                                                445

GCCATTGGTAGAGTAGGAAA                                                446

CAGGAAGTTGTAAGTGCAGG                                                447

ACTGAGTGATTACAGGGCAA                                                448

GGTAGCTGATGAAGACATCT                                                449

GAAGGGAATGCAGAACCACC                                                450

GCTTCTCCACATCAATGAAG                                                451

AGCTTCTCCACATCAATGAA                                                452

ATGACACTCTGGATGAGTTT                                                453

TGACACTCTGGATGAGTTTG                                                454

TGGTAGAGTAGGAAACCAGG                                                455

TTTTGGGAAAGAGGGACCC                                                 456

GTTTTGGGAAAGAGGGACC                                                 457

CTCTCCAGATACTGAGGAAA                                                458

CTCCAGATACTGAGGAAAGT                                                459

GCTTAAAGCAGTCACAATCT                                                460

GTAGCTGATGAAGACATCTG                                                461

GGTTTTGGGAAAGAGGGAC                                                 462

TTGAAAGTAAGCACAGCCTG                                                463

CCAGATACTGAGGAAAGTGG                                                464

TTGGTAGAGTAGGAAACCAG                                                465

CCTGGATGTGGCAAAAGATA                                                466

GGATGTGGCAAAAGATACCA                                                467

TAGCTGATGAAGACATCTGG                                                468

ATTGGTAGAGTAGGAAACCA                                                469

CATTGGTAGAGTAGGAAACC                                                470

CCATTGGTAGAGTAGGAAAC                                                471

TCTCCACATCAATGAAGACA                                                472

TCTCCAGATACTGAGGAAAG                                                473

AGCTTAAAGCAGTCACAATC                                                474

-continued

| | |
|---|---|
| CAGCTTAAAGCAGTCACAAT | 475 |
| TCCAGATACTGAGGAAAGTG | 476 |
| CAGATACTGAGGAAAGTGGG | 477 |
| TGGATGTGGCAAAAGATACC | 478 |
| TCCACATCAATGAAGACACT | 479 |
| CTCCACATCAATGAAGACAC | 480 |
| TTCTCCACATCAATGAAGAC | 481 |
| TGTGGCAAAAGATACCACAC | 482 |
| GATGTGGCAAAAGATACCAC | 483 |
| ATGTGGCAAAAGATACCACA | 484 |
| TCTTTGAAGCAAGGGAGAAG | 485 |
| CCACATCAATGAAGACACTG | 486 |
| CACATCAATGAAGACACTGA | 487 |
| ACATCAATGAAGACACTGAA | 488 |
| AGCCATCAATGATGGGCACA | 489 |
| GATGGGCACAATGTTCTTGC | 490 |
| GCCATCAATGATGGGCACAA | 491 |
| ATGATGGGCACAATGTTCTT | 492 |
| TGATGGGCACAATGTTCTTG | 493 |
| CCATCAATGATGGGCACAAT | 494 |
| AATGATGGGCACAATGTTCT | 495 |
| CAATGATGGGCACAATGTTC | 496 |
| TCAATGATGGGCACAATGTT | 497 |
| ATCAATGATGGGCACAATGT | 498 |
| CATCAATGATGGGCACAATG | 499 |
| ATGGGCACAATGTTCTTGCC | 500 |
| CTCAATGGTGGCCTCCTGGT | 501 |
| ATGGTGGCCTCCTGGTATTC | 502 |
| TCAATGGTGGCCTCCTGGTA | 503 |
| CACCTTCAGGAGACTGGCCA | 504 |
| TGCACCTTCAGGAGACTGGC | 505 |
| GTGCACCTTCAGGAGACTGG | 506 |
| GAAGCCATCAATGATGGGCA | 507 |
| ACATCTGGAGTGTCCCCACT | 508 |
| CCTTGCAGTCATGGTCTTGC | 509 |
| GACATCTGGAGTGTCCCCAC | 510 |
| CATCTGGAGTGTCCCCACTG | 511 |
| AGACATCTGGAGTGTCCCCA | 512 |
| GCAGTCATGGTCTTGCATGC | 513 |
| TCCTTGCAGTCATGGTCTTG | 514 |

-continued

| | |
|---|---|
| AAGACATCTGGAGTGTCCCC | 515 |
| GCTGAACACCTTGGTCTTGC | 516 |
| CTGAACACCTTGGTCTTGCC | 517 |
| ATGATCTTCTCAATGGTGGC | 518 |
| GATGATCTTCTCAATGGTGG | 519 |
| GGATGATCTTCTCAATGGTG | 520 |
| GCAGCTTAAAGCAGTCACAA | 521 |
| TCTGGAGTGTCCCCACTGGG | 522 |
| ATCTGGAGTGTCCCCACTGG | 523 |
| CAATGGTGGCCTCCTGGTAT | 524 |
| AATGGTGGCCTCCTGGTATT | 525 |
| CTGATGAAGACATCTGGAGT | 526 |
| ATCCTTGCAGTCATGGTCTT | 527 |
| GAACACCTTGGTCTTGCCTT | 528 |
| TGAACACCTTGGTCTTGCCT | 529 |
| AATCCTTGCAGTCATGGTCT | 530 |
| AACACCTTGGTCTTGCCTTG | 531 |
| GAAGACATCTGGAGTGTCCC | 532 |
| TCAGACACTGTATTGTTATT | 533 |
| CAGACACTGTATTGTTATTG | 534 |
| GACACTGAAGCCATGCAGCT | 535 |
| ACACTGAAGCCATGCAGCTG | 536 |
| AGACACTGAAGCCATGCAGC | 537 |
| CTCTGGATGAGTTTGTCCTC | 538 |
| CTGGAGTGTCCCCACTGGGT | 539 |
| GGAGTGTCCCCACTGGGTTT | 540 |
| TGGAGTGTCCCCACTGGGTT | 541 |
| GAGTGTCCCCACTGGGTTTG | 542 |
| CACCTTGGTCTTGCCTTGCA | 543 |
| ACACCTTGGTCTTGCCTTGC | 544 |
| TTGACTTTCTGATGATGTGG | 545 |
| ACTCTGGATGAGTTTGTCCT | 546 |
| CACTCTGGATGAGTTTGTCC | 547 |
| GCAGGTTCTGTCTAGGCTGC | 548 |
| GCTGCAGGTTCTGTCTAGGC | 549 |
| CAGGTTCTGTCTAGGCTGCT | 550 |
| CTGCAGGTTCTGTCTAGGCT | 551 |
| TGCAGGTTCTGTCTAGGCTG | 552 |
| AACCCAATGGCAGGGCCTGG | 553 |

-continued

| | |
|---|---|
| CAACCCAATGGCAGGGCCTG | 554 |
| GTGTCTCCAGAACTGAGCAG | 555 |
| GGGCTGCCTGGTCCCTGAGT | 556 |
| GGCTGCCTGGTCCCTGAGTA | 557 |
| GCCTGACTTCCCTTCCCTCT | 558 |
| GTCCTGTGAGGGCAGTGTCC | 559 |
| ACTCATCCCTGGCTGGCTCC | 560 |
| GTGAGGGCAGTGTCCAGGCT | 561 |
| GTGGGTAGCCCTGGATGGCT | 562 |
| GTATGGCCTCTGGGTCAGCT | 563 |
| AGTGGGTTGGAGGTGGGCCA | 564 |
| GTGGGTTGGAGGTGGGCCAT | 565 |
| TGTGAGGGCAGTGTCCAGGC | 566 |
| GGGTAGCCCTGGATGGCTGA | 567 |
| CCCCAACTCCAGTGTCTCCA | 568 |
| GTTGTCTCAGCCCAGGGAGA | 569 |
| CTGTCCTGTGAGGGCAGTGT | 570 |
| CCCAGATGCAGGGAGTGGGC | 571 |
| TGTCCTGTGAGGGCAGTGTC | 572 |
| CCTGTGAGGGCAGTGTCCAG | 573 |
| ATGGCCTCTGGGTCAGCTTT | 574 |
| GCTGCCTGGTCCCTGAGTAA | 575 |
| TGCAGGCCCAGATGCAGGGA | 576 |
| GGGTTGGAGGTGGGCCATGA | 577 |
| GGCTGCCCTGCTTGTCATAT | 578 |
| TGGGTAGCCCTGGATGGCTG | 579 |
| CTGTGAGGGCAGTGTCCAGG | 580 |
| AAGCCTGACTTCCCTTCCCT | 581 |
| GGTGATGCAGGCCCAGATGC | 582 |
| TATGGCCTCTGGGTCAGCTT | 583 |
| TGTCCAGTGCTCCAGGTGAT | 584 |
| GCTGCCCTGCTTGTCATATC | 585 |
| AAGTGGGTTGGAGGTGGGCC | 586 |
| GTAGCCCTGGATGGCTGAGG | 587 |
| ATGCAGGCCCAGATGCAGGG | 588 |
| GTCCAGTGCTCCAGGTGATA | 589 |
| CAAGCCTGACTTCCCTTCCC | 590 |
| CCAAGCCTGACTTCCCTTCC | 591 |
| TGCCTGGTCCCTGAGTAAGC | 592 |
| GCCTGGAGCCTGGGTTTATT | 593 |

-continued

| | |
|---|---|
| AGGCCCAGATGCAGGGAGTG | 594 |
| GTGCTCCAGGTGATAGCACC | 595 |
| TGGGTTGGAGGTGGGCCATG | 596 |
| GGTTCTGTCTAGGCTGCTTT | 597 |
| AGGTTCTGTCTAGGCTGCTT | 598 |
| CTGCCCTGCTTGTCATATCC | 599 |
| AAGCAGTGGGTAGCCCTGGA | 600 |
| GTGATGCAGGCCCAGATGCA | 601 |
| TTGTCTCAGCCCAGGGAGAC | 602 |
| CCCAACTCCAGTGTCTCCAG | 603 |
| GTTGGAGGTGGGCCATGAGG | 604 |
| GGTTGGAGGTGGGCCATGAG | 605 |
| CAGAGCTGCAGGTTCTGTCT | 606 |
| GATGCAGGCCCAGATGCAGG | 607 |
| GCTTGTCATATCCATGCCCT | 608 |
| GCCCTGCTTGTCATATCCAT | 609 |
| GGCTGGCACTGGCCAAGACA | 610 |
| TGCCCTGCTTGTCATATCCA | 611 |
| AGCTGCAGGTTCTGTCTAGG | 612 |
| TTGGAGGTGGGCCATGAGGG | 613 |
| AGAATACAGTGCCCAGGCCC | 614 |
| AGGCTGGCACTGGCCAAGAC | 615 |
| GTTTCAGGAGCTGTTCCTTC | 616 |
| CTGCCTGGTCCCTGAGTAAG | 617 |
| TGCTCCAGGTGATAGCACCA | 618 |
| CCCTTTGCCTTTTCAGGACT | 619 |
| GCAGCCAGCTTTAAGGTGTC | 620 |
| GGCAAAGGTGATGCAGGCCC | 621 |
| GTTCTGTCTAGGCTGCTTTT | 622 |
| GAGCTGCAGGTTCTGTCTAG | 623 |
| AGAGCTGCAGGTTCTGTCTA | 624 |
| GTCAGGCTAGCTAAGGGCAC | 625 |
| CCAACTCCAGTGTCTCCAGA | 626 |
| AGGTGATGCAGGCCCAGATG | 627 |
| TGCTTGTCATATCCATGCCC | 628 |
| AGTCAGGCTAGCTAAGGGCA | 629 |
| GCTGGCACTGGCCAAGACAG | 630 |
| AGTGCTCCAGGTGATAGCAC | 631 |
| TCAGGAGCTGTTCCTTCAGA | 632 |

-continued

| | |
|---|---|
| TCTAGGCTGCTTTTACTGCC | 633 |
| TGATGCAGGCCCAGATGCAG | 634 |
| ACAACCCAATGGCAGGGCCT | 635 |
| ACCCTTTGCCTTTTCAGGAC | 636 |
| ACCCTCTGAACCCAGTGGAG | 637 |
| GCAAAGGTGATGCAGGCCCA | 638 |
| GACTGGTTAGGTTGGACCCA | 639 |
| GTCTAGGCTGCTTTTACTGC | 640 |
| ACAGTCTGAGTGGAGAGCCA | 641 |
| CACAGTCTGAGTGGAGAGCC | 642 |
| GACAACCCAATGGCAGGGCC | 643 |
| AGGAAGTCAGAGGGAGGGCT | 644 |
| TCAGGCTAGCTAAGGGCACT | 645 |
| CCTGGAGCCTGGGTTTATTG | 646 |
| TCTTACCCTCTGAACCCAGT | 647 |
| GCACTTGTGCTGCATGAGGA | 648 |
| GGGTTTATTGGAGGGTGCTT | 649 |
| TTCAGGAGCTGTTCCTTCAG | 650 |
| TACCCTCTGAACCCAGTGGA | 651 |
| GGAGAGCCATGATGGCACTC | 652 |
| CTGCTTGTCATATCCATGCC | 653 |
| CCTGCTTGTCATATCCATGC | 654 |
| CAGTCTGAGTGGAGAGCCAT | 655 |
| ATCTGGGACTTAGTCAGGCT | 656 |
| TAGTCAGGCTAGCTAAGGGC | 657 |
| GTGGAGAGCCATGATGGCAC | 658 |
| GTCTGAGTGGAGAGCCATGA | 659 |
| GAGTGGAGAGCCATGATGGC | 660 |
| TGGGTTTATTGGAGGGTGCT | 661 |
| CTGGGTTTATTGGAGGGTGC | 662 |
| GTGAGCACTTGTGCTGCATG | 663 |
| AAGGTGATGCAGGCCCAGAT | 664 |
| GCTAGCTAAGGGCACTGAGT | 665 |
| GGCACAGTCTGAGTGGAGAG | 666 |
| AGGCACAGTCTGAGTGGAGA | 667 |
| AGTGGAGAGCCATGATGGCA | 668 |
| CCCTGCTTGTCATATCCATG | 669 |
| CTGGAGCCTGGGTTTATTGG | 670 |
| GGCACTGGCCAAGACAGACT | 671 |
| CAGGCACAGTCTGAGTGGAG | 672 |

-continued

| | |
|---|---|
| TTACCCTCTGAACCCAGTGG | 673 |
| AGCACTTGTGCTGCATGAGG | 674 |
| GATCTGGGACTTAGTCAGGC | 675 |
| GAGCCTGGGTTTATTGGAGG | 676 |
| GGAGCCTGGGTTTATTGGAG | 677 |
| CAGCCAGCTTTAAGGTGTCA | 678 |
| CCTGGGTTTATTGGAGGGTG | 679 |
| ATGGAAGTCACAGCAGGGCT | 680 |
| CTCCAGTGTCTCCAGAACTG | 681 |
| GGCTAGCTAAGGGCACTGAG | 682 |
| AGGCTAGCTAAGGGCACTGA | 683 |
| GGAGAGAAGGGTACCAGGCA | 684 |
| TGGAGCCTGGGTTTATTGGA | 685 |
| GAGAGCCATGATGGCACTCA | 686 |
| CTTACCCTCTGAACCCAGTG | 687 |
| GCAAAGCTGGCTGCAGTGAC | 688 |
| CAGGCTAGCTAAGGGCACTG | 689 |
| AGTCTGAGTGGAGAGCCATG | 690 |
| CTGGCACTGGCCAAGACAGA | 691 |
| CTGTCTAGGCTGCTTTTACT | 692 |
| TGGAGAGCCATGATGGCACT | 693 |
| AGCAAAGCTGGCTGCAGTGA | 694 |
| GCACTGGCCAAGACAGACTC | 695 |
| AACCCTTTGCCTTTTCAGGA | 696 |
| CAGCAAAGCTGGCTGCAGTG | 697 |
| CAACCCTTTGCCTTTTCAGG | 698 |
| TCTGTCTAGGCTGCTTTTAC | 699 |
| GAGCACTTGTGCTGCATGAG | 700 |
| GGGCAATGGGATATTCCTGC | 701 |
| GGTTTATTGGAGGGTGCTTT | 702 |
| TTCTGTCTAGGCTGCTTTTA | 703 |
| TGAGCACTTGTGCTGCATGA | 704 |
| GTGACAACCCTTTGCCTTTT | 705 |
| TTCTTACCCTCTGAACCCAG | 706 |
| TGGAGAGAAGGGTACCAGGC | 707 |
| AGTGTCTCCAGAACTGAGCA | 708 |
| CAGTGTCTCCAGAACTGAGC | 709 |
| AAAGGTGATGCAGGCCCAGA | 710 |
| TGGCACTGGCCAAGACAGAC | 711 |

-continued

| | |
|---|---|
| GGCAATGGGATATTCCTGCT | 712 |
| CAAAGGTGATGCAGGCCCAG | 713 |
| GACAACCCTTTGCCTTTTCA | 714 |
| GTTGCAAAATCCTATCCCCC | 715 |
| CAGGAGCTGTTCCTTCAGAA | 716 |
| TCCTAAGAAGAGCCCAGGTT | 717 |
| TTCCTAAGAAGAGCCCAGGT | 718 |
| CCAGTGTCTCCAGAACTGAG | 719 |
| CCCAAACCTGGAGTGAGACC | 720 |
| GTTTATTGGAGGGTGCTTTC | 721 |
| CCTGGAGTGAGACCTTTGAC | 722 |
| GAGGGAGAGCCATTTCCTAA | 723 |
| TCTGAGTGGAGAGCCATGAT | 724 |
| GCAATGGGATATTCCTGCTC | 725 |
| TGTCTAGGCTGCTTTTACTG | 726 |
| ACAACCCTTTGCCTTTTCAG | 727 |
| GACTTTCTGATGATGTGGCC | 728 |
| CACTGGCCAAGACAGACTCT | 729 |
| TGACAACCCTTTGCCTTTTC | 730 |
| CAACTCCAGTGTCTCCAGAA | 731 |
| GCCAGCTTTAAGGTGTCAAC | 732 |
| CAAAGCTGGCTGCAGTGACA | 733 |
| AGCCAGCTTTAAGGTGTCAA | 734 |
| GCCATTTCCTAAGAAGAGCC | 735 |
| CCTAAGAAGAGCCCAGGTTG | 736 |
| TTATTGGAGGGTGCTTTCTT | 737 |
| TGAGTGGAGAGCCATGATGG | 738 |
| CCAAACCTGGAGTGAGACCT | 739 |
| CCATTTCCTAAGAAGAGCCC | 740 |
| CTGGAGTGAGACCTTTGACT | 741 |
| GCTGCAGTGACAAGGAAGTC | 742 |
| AAGCTGGCTGCAGTGACAAG | 743 |
| CTGAGTGGAGAGCCATGATG | 744 |
| TTTCCTAAGAAGAGCCCAGG | 745 |
| GGCAAAGATTTGTGAGGGCT | 746 |
| CACTTGTGCTGCATGAGGAA | 747 |
| CCTGGAGATACTCAGACACT | 748 |
| TGTTGCAAAATCCTATCCCC | 749 |
| TGGAGTGAGACCTTTGACTT | 750 |
| AGTGAGACCTTTGACTTTCT | 751 |

-continued

| | |
|---|---|
| AACCTGGAGTGAGACCTTTG | 752 |
| GCTGCATGAGGAAAGGAGGA | 753 |
| GTGAGACCTTTGACTTTCTG | 754 |
| CATTTCCTAAGAAGAGCCCA | 755 |
| AAAGCTGGCTGCAGTGACAA | 756 |
| TGACTTTCTGATGATGTGGC | 757 |
| AGCCATTTCCTAAGAAGAGC | 758 |
| CAAACCTGGAGTGAGACCTT | 759 |
| TGGCAAAGATTTGTGAGGGC | 760 |
| TGTGCTGCATGAGGAAAGGA | 761 |
| ATTTCCTAAGAAGAGCCCAG | 762 |
| CTGCAGTGACAAGGAAGTCA | 763 |
| GCAAAGATTTGTGAGGGCTT | 764 |
| GCAGTGACAAGGAAGTCAGA | 765 |
| GTGCTTTAGAGATTTGCTAC | 766 |
| AAACCTGGAGTGAGACCTTT | 767 |
| GGAATGGAGAGAAGGGTACC | 768 |
| TGAGACCTTTGACTTTCTGA | 769 |
| TGGAGATACTCAGACACTGT | 770 |
| TTGTGCTGCATGAGGAAAGG | 771 |
| TTGTTGCAAAATCCTATCCC | 772 |
| ACTTGTGCTGCATGAGGAAA | 773 |
| GGAGATACTCAGACACTGTA | 774 |
| GGAGACAGACAACCCAATGG | 775 |
| CTGCTAGATTCTTTGAAGCA | 776 |
| CTTGTGCTGCATGAGGAAAG | 777 |
| TGAGGAAAGGAGGATCAGGT | 778 |
| TGCAGTGACAAGGAAGTCAG | 779 |
| GTGGCAAAGATACCACACC | 780 |
| GCATGAGGAAAGGAGGATCA | 781 |
| GAGCCATTTCCTAAGAAGAG | 782 |
| AGAGCCATTTCCTAAGAAGA | 783 |
| GGAGAAGGGAATGCAGAACC | 784 |
| TCTCAGGAAAGCAATTCCAC | 785 |
| CAAAGATTTGTGAGGGCTTC | 786 |
| CTGCATGAGGAAAGGAGGAT | 787 |
| AATGGAGAGAAGGGTACCAG | 788 |
| AAATGGAAGTCACAGCAGGG | 789 |
| GATACTGAGGAAAGTGGGTT | 790 |

-continued

```
TGCATGAGGAAAGGAGGATC                              791

AGATACTGAGGAAAGTGGGT                              792

GAGATACTCAGACACTGTAT                              793

ATGGCAAAGATTTGTGAGGG                              794

ATTCTCAGGAAAGCAATTCC                              795

AGGAATGGAGAGAAGGGTAC                              796

GATTCTTTGAAGCAAGGGAG                              797

AGATTCTTTGAAGCAAGGGA                              798

GAAATGGAAGTCACAGCAGG                              799

GGAAATGGAAGTCACAGCAG                              800

TTTGTTGCAAAATCCTATCC                              801

ATGAGGAAAGGAGGATCAGG                              802

TGGAAATGGAAGTCACAGCA                              803

AGATACTCAGACACTGTATT                              804

GCTAGATTCTTTGAAGCAAG                              805

TGCTAGATTCTTTGAAGCAA                              806

AGGAGAAGGGAATGCAGAAC                              807

ATGGAAATGGAAGTCACAGC                              808

CATGAGGAAAGGAGGATCAG                              809

TAGATTCTTTGAAGCAAGGG                              810

TTCTTTGAAGCAAGGGAGAA                              811

GATTCTCAGGAAAGCAATTC                              812

CTAGATTCTTTGAAGCAAGG                              813

GAATGATTCTCAGGAAAGCA                              814

TTTTGTTGCAAAATCCTATC                              815

TGATTCTCAGGAAAGCAATT                              816

AGAATGATTCTCAGGAAAGC                              817

ATGATTCTCAGGAAAGCAAT                              818

AATGGCAAAGATTTGTGAGG                              819

GATGGAAATGGAAGTCACAG                              820

AATGATTCTCAGGAAAGCAA                              821

AAATGGCAAAGATTTGTGAG                              822

CTCAAGCTGACTGCTATCAG                              823

TCCTCAAGCTGACTGCTATC                              824

CCTCAAGCTGACTGCTATCA                              825

AGACACTGTATTGTTATTGG                              826

ATGGGATATTCCTGCTCTGT                              827

GATAGCACCAACACAAAGTT                              828

GCCCCCATCTGGCCCAGGCA                              829

AAGAGCCTTCAGCAGCCCCC                              830
```

-continued

| | |
|---|---|
| GCTGTCCTGTGAGGGCAGTG | 831 |
| AGTGGGTAGCCCTGGATGGC | 832 |
| TGTATGGCCTCTGGGTCAGC | 833 |
| GCCTGGTCCCTGAGTAAGCA | 834 |
| TGTCTCAGCCCAGGGAGACT | 835 |
| GGAGGGTGCTTTCTTACCCT | 836 |
| AGGGTGCTTTCTTACCCTCT | 837 |
| GGGTGCTTTCTTACCCTCTG | 838 |
| GAGGGTGCTTTCTTACCCTC | 839 |
| CCTCTGGGTCAGCTTTTTGT | 840 |
| AGTAAGCAGTGGGTAGCCCT | 841 |
| GGTTTCAGGAGCTGTTCCTT | 842 |
| GTAAGCAGTGGGTAGCCCTG | 843 |
| GAGTAAGCAGTGGGTAGCCC | 844 |
| GGTGCTTTCTTACCCTCTGA | 845 |
| TCCCTGAGTAAGCAGTGGGT | 846 |
| GTCCCTGAGTAAGCAGTGGG | 847 |
| GGTCCCTGAGTAAGCAGTGG | 848 |
| GGGACTTAGTCAGGCTAGCT | 849 |
| TAAGCAGTGGGTAGCCCTGG | 850 |
| GGTGAGCACTTGTGCTGCAT | 851 |
| CCTGGTCCCTGAGTAAGCAG | 852 |
| CTGGTCCCTGAGTAAGCAGT | 853 |
| GGGACTGGTTAGGTTGGACC | 854 |
| GGAGGGAGAGCCATTTCCTA | 855 |
| CCCTGAGTAAGCAGTGGGTA | 856 |
| TGGGACTTAGTCAGGCTAGC | 857 |
| GCTCCAGGTGATAGCACCAA | 858 |
| GGAAAGAGCCTTCAGCAGCC | 859 |
| TGGTCCCTGAGTAAGCAGTG | 860 |
| TGAGTAAGCAGTGGGTAGCC | 861 |
| TCTGGGACTTAGTCAGGCTA | 862 |
| GGACTTAGTCAGGCTAGCTA | 863 |
| GGGAAAGAGCCTTCAGCAGC | 864 |
| GTGCTTTCTTACCCTCTGAA | 865 |
| CTGGGACTTAGTCAGGCTAG | 866 |
| CTGAGTAAGCAGTGGGTAGC | 867 |
| AGTGACAACCCTTTGCCTTT | 868 |
| CCTGAGTAAGCAGTGGGTAG | 869 |

-continued

| | |
|---|---|
| AGAACTAGGAGTCACCTGGC | 870 |
| CTCCAGGTGATAGCACCAAC | 871 |
| ACTTTCTGATGATGTGGCCA | 872 |
| TCCAGGTGATAGCACCAACA | 873 |
| TTAGTCAGGCTAGCTAAGGG | 874 |
| ATTGGAGGGTGCTTTCTTAC | 875 |
| GTGGCCAAGAACTAGGAGTC | 876 |
| TGCTTTCTTACCCTCTGAAC | 877 |
| AAGTGACAACCCTTTGCCTT | 878 |
| CTTAGTCAGGCTAGCTAAGG | 879 |
| TATTGGAGGGTGCTTTCTTA | 880 |
| TAAGTGACAACCCTTTGCCT | 881 |
| CAATGGGATATTCCTGCTCT | 882 |
| GACTTAGTCAGGCTAGCTAA | 883 |
| TGTGGCCAAGAACTAGGAGT | 884 |
| GCTGCTAGATTCTTTGAAGC | 885 |
| CTTTCTGATGATGTGGCCAA | 886 |
| CCAGCTTTAAGGTGTCAACA | 887 |
| ACTTAGTCAGGCTAGCTAAG | 888 |
| AATGGGATATTCCTGCTCTG | 889 |
| TTCTGATGATGTGGCCAAGA | 890 |
| AGCTTTAAGGTGTCAACACC | 891 |
| GTGCTGCATGAGGAAAGGAG | 892 |
| GATGTGGCCAAGAACTAGGA | 893 |
| TTTCTGATGATGTGGCCAAG | 894 |
| GAGACCTTTGACTTTCTGAT | 895 |
| GACCTTTGACTTTCTGATGA | 896 |
| ATGTGGCCAAGAACTAGGAG | 897 |
| GACACTGTATTGTTATTGGC | 898 |
| AGACCTTTGACTTTCTGATG | 899 |
| CAGCTTTAAGGTGTCAACAC | 900 |
| ACCTTTGACTTTCTGATGAT | 901 |
| TAGCACCAACACAAAGTTGC | 902 |
| GGTGATAGCACCAACACAAA | 903 |
| TGATAGCACCAACACAAAGT | 904 |
| GTGATAGCACCAACACAAAG | 905 |
| CTTTTTGTTGCAAAATCCTA | 906 |
| ATAGCACCAACACAAAGTTG | 907 |
| TCAAGCTGACTGCTATCAGC | 908 |
| TCCATGCCCTGGCTCTGGCC | 909 |

-continued

| | |
|---|---|
| CTCAGCCCAGGGAGACTGGT | 910 |
| GTCTCAGCCCAGGGAGACTG | 911 |
| GGTGTCAACACCTGGCCCTT | 912 |
| TCAGCCCAGGGAGACTGGTT | 913 |
| TCTCAGCCCAGGGAGACTGG | 914 |
| TGTCATATCCATGCCCTGGC | 915 |
| CAGCCCAGGGAGACTGGTTT | 916 |
| TCCTCCTCAAGCTGACTGCT | 917 |
| AAAGAGCCTTCAGCAGCCCC | 918 |
| CTGGTTTCAGGAGCTGTTCC | 919 |
| AAGTCAGAGGGAGGGCTGGT | 920 |
| GAAAGAGCCTTCAGCAGCCC | 921 |
| CCTCCTCAAGCTGACTGCTA | 922 |
| CTGGGTCAGCTTTTTGTTGC | 923 |
| TTGTCATATCCATGCCCTGG | 924 |
| TCTGGGTCAGCTTTTTGTTG | 925 |
| GCCCTAAGTGACAACCCTTT | 926 |
| TGGGATATTCCTGCTCTGTA | 927 |
| CTCCTCAAGCTGACTGCTAT | 928 |
| GCCAAGAACTAGGAGTCACC | 929 |
| CTAAGTGACAACCCTTTGCC | 930 |
| CCTAAGTGACAACCCTTTGC | 931 |
| GCTTTAAGGTGTCAACACCT | 932 |
| GGCCAAGAACTAGGAGTCAC | 933 |
| CCCTAAGTGACAACCCTTTG | 934 |
| TGGCCAAGAACTAGGAGTCA | 935 |
| CCAAGAACTAGGAGTCACCT | 936 |
| GCAGGAGAAGGGAATGCAGA | 937 |
| AAGAACTAGGAGTCACCTGG | 938 |
| TTTAAGGTGTCAACACCTGG | 939 |
| TGATGTGGCCAAGAACTAGG | 940 |
| TCTGATGATGTGGCCAAGAA | 941 |
| CTTTAAGGTGTCAACACCTG | 942 |
| GCTTTTTGTTGCAAAATCCT | 943 |
| TGATGATGTGGCCAAGAACT | 944 |
| CTGATGATGTGGCCAAGAAC | 945 |
| CAAGAACTAGGAGTCACCTG | 946 |
| GATGATGTGGCCAAGAACTA | 947 |
| ATGATGTGGCCAAGAACTAG | 948 |

-continued

| | |
|---|---|
| TTAATGTCCCTGAGCAGTTC | 949 |
| CCAGAAGGCCACACAGGGCA | 950 |
| TCCTTCCAGCCCAAACTGCA | 951 |
| TAATGTCCCTGAGCAGTTCT | 952 |
| TAGAGGAGGCTTGTGACTTC | 953 |
| TTTAATGTCCCTGAGCAGTT | 954 |
| TTAGAGGAGGCTTGTGACTT | 955 |
| GTCCCAGGTTGCCCCTCTCC | 956 |
| CCTCCTGGGAGCTGGCCTCC | 957 |
| CTGCTCCCAGTCTGCCTGCC | 958 |
| GTCTTGTCCCAGGTTGCCCC | 959 |
| TGTCCCAGGTTGCCCCTCTC | 960 |
| GCTCCCAGTCTGCCTGCCAT | 961 |
| TGCTCCCAGTCTGCCTGCCA | 962 |
| GGTTCCCCTTCCTCCTGGGA | 963 |
| CTCCTGGGAGCTGGCCTCCT | 964 |
| TCCTCCTGGGAGCTGGCCTC | 965 |
| CTGGGCTGGGCAGGAGCCCT | 966 |
| GGAGCCCTGAGCTGCCTGGT | 967 |
| CCCTCTGGGTGTCTTGTCCC | 968 |
| TTCCTGCTCCCAGTCTGCCT | 969 |
| TTGTCCCAGGTTGCCCCTCT | 970 |
| CTTGTCCCAGGTTGCCCCTC | 971 |
| TCTTGTCCCAGGTTGCCCCT | 972 |
| GCTGGGCAGGAGCCCTGAGC | 973 |
| AGCAGTTTCCCCAGAGCCCC | 974 |
| GCCCTCTGTTTTCCTGCTCC | 975 |
| GGGCCCTCTGTTTTCCTGCT | 976 |
| TTCCTCCTGGGAGCTGGCCT | 977 |
| GGTTGCCCCTCTCCTTGCAG | 978 |
| AGGTTGCCCCTCTCCTTGCA | 979 |
| CAGGTTGCCCCTCTCCTTGC | 980 |
| GGCTGGGCCACAGGCTAGCT | 981 |
| CTGTGGGTTCTGGTGTCCCC | 982 |
| GGCCCTCTGTTTTCCTGCTC | 983 |
| TGGGCTGGGCAGGAGCCCTG | 984 |
| TTTCCTGCTCCCAGTCTGCC | 985 |
| CTGGACCAGCCCACCCCAGT | 986 |
| CCCAGAGCCCCTGATCTGCC | 987 |
| CCCCAGAGCCCCTGATCTGC | 988 |

-continued

| | |
|---|---|
| CCTGGACCAGCCCACCCCAG | 989 |
| CCAGGTTGCCCCTCTCCTTG | 990 |
| GCCCCTGATCTGCCTGGACC | 991 |
| GTGTCTTGTCCCAGGTTGCC | 992 |
| GTTGCCCCTCTCCTTGCAGA | 993 |
| TGTCTTGTCCCAGGTTGCCC | 994 |
| GCAGCTGGAAGCCCAGCCCA | 995 |
| ATCCATGCCCTGGCTCTGGC | 996 |
| CCTCTGGGTGTCTTGTCCCA | 997 |
| GCCCAGCCCACAGCAGGACA | 998 |
| GGCCTTGAGGGTTCCCCACA | 999 |
| CCAGCAGTTTCCCCAGAGCC | 1000 |
| GAGCCCTGAGCTGCCTGGTG | 1001 |
| GTGTTCTCTCTCCCAGTTCC | 1002 |
| CCCTGAGCAGTTCTTGGCCC | 1003 |
| ACCCTCTGGGTGTCTTGTCC | 1004 |
| TACCTGGACCAGCCCACCCC | 1005 |
| GGTGTCTTGTCCCAGGTTGC | 1006 |
| AGTTTCCCCAGAGCCCCTGA | 1007 |
| GGCACCACCCCATCCACAGC | 1008 |
| AGCCCAGCCCACAGCAGGAC | 1009 |
| TCCTCCAGCTCTCAGCTTCT | 1010 |
| AGGAGCCCTGAGCTGCCTGG | 1011 |
| GCCTCTCTTCATGGGCCTGG | 1012 |
| TGGCTGGGCCACAGGCTAGC | 1013 |
| CTGGGTGTCTTGTCCCAGGT | 1014 |
| GTTTCCCCAGAGCCCCTGAT | 1015 |
| AGGCTGTGTTCTCTCTCCCA | 1016 |
| ACCTTCTGGTGCCTTGGGCT | 1017 |
| GCTACCTGGACCAGCCCACC | 1018 |
| TGCAGCTGGAAGCCCAGCCC | 1019 |
| TTCCCCAGAGCCCCTGATCT | 1020 |
| GCTATGGCCTACCCACTCCC | 1021 |
| AGCCCACTGTGGGTTCTGGT | 1022 |
| CCTTCTGGTGCCTTGGGCTT | 1023 |
| GCCTCTGGGTCTTTATGCCC | 1024 |
| CTCTCTCCCAGTTCCCCTAT | 1025 |
| CTCCCAGTCTGCCTGCCATA | 1026 |
| TGGACCAGCCCACCCCAGTA | 1027 |

-continued

| | |
|---|---|
| ATGGCCTACCCACTCCCCTG | 1028 |
| CCCTGGCCCTACAGACCTGT | 1029 |
| TCCCCAGAGCCCCTGATCTG | 1030 |
| GCCCACTGTGGGTTCTGGTG | 1031 |
| GAGCCCCTGATCTGCCTGGA | 1032 |
| CTACCTGGACCAGCCCACCC | 1033 |
| GCTAGTTGTGGCTGGGCCAC | 1034 |
| ACTGTGGGTTCTGGTGTCCC | 1035 |
| CAGCCCCAACCAGGTTCCCA | 1036 |
| TCCAGCAGTTTCCCCAGAGC | 1037 |
| CCTGAGCAGTTCTTGGCCCT | 1038 |
| GGCTATGGCCTACCCACTCC | 1039 |
| TATGGCCTACCCACTCCCCT | 1040 |
| CTATGGCCTACCCACTCCCC | 1041 |
| TCCACAGCTGACCCAGCCTC | 1042 |
| GTCCCTGAGCAGTTCTTGGC | 1043 |
| AGCTAGTTGTGGCTGGGCCA | 1044 |
| CAGCTAGTTGTGGCTGGGCC | 1045 |
| TCCCTGAGCAGTTCTTGGCC | 1046 |
| CCTCTGGGTCTTTATGCCCC | 1047 |
| CAGGAGCCCTGAGCTGCCTG | 1048 |
| TTTTCCTGCTCCCAGTCTGC | 1049 |
| ACAGCCCCAACCAGGTTCCC | 1050 |
| GAGGGCTGGCATCTCTCCTT | 1051 |
| CCCTGAGCTGCCTGGTGGAT | 1052 |
| CTGCAGCTGGAAGCCCAGCC | 1053 |
| GGGTGTCTTGTCCCAGGTTG | 1054 |
| TGGGTGTCTTGTCCCAGGTT | 1055 |
| AGCCCCTGATCTGCCTGGAC | 1056 |
| CCCCATCCACAGCTGACCCA | 1057 |
| GGGTCTTTATGCCCCAGTCT | 1058 |
| TTTCCCCAGAGCCCCTGATC | 1059 |
| GCCAGGCCTAGGTGCTTGAC | 1060 |
| CCCACTGTGGGTTCTGGTGT | 1061 |
| TCCCAGTCTGCCTGCCATAC | 1062 |
| CCCCTGATCTGCCTGGACCA | 1063 |
| TCTGGGTGTCTTGTCCCAGG | 1064 |
| TCCTGCTCTGTATGGCCTCT | 1065 |
| GCCTTGAGGGTTCCCCACAT | 1066 |
| GTCAGTTCTCCCTTTCTGCT | 1067 |

-continued

| | |
|---|---|
| GGGCTGGTTTGCCTCAACCC | 1068 |
| AGAGCCCCTGATCTGCCTGG | 1069 |
| GAGTTCCAGCAGTTTCCCCA | 1070 |
| GGTCTGCAGCTGGAAGCCCA | 1071 |
| TCTCTCCCAGTTCCCCTATT | 1072 |
| AGCCAGGCCTAGGTGCTTGA | 1073 |
| GTACCTGGTTAGTGCCAGCC | 1074 |
| AGGCCCACTGCAGGACAGGT | 1075 |
| GACAGGCCTTGAGGGTTCCC | 1076 |
| GATCTGGCTGACTCAGCCCC | 1077 |
| GGTTAGTGCCAGCCTTGGGA | 1078 |
| GCCTAGGTGCTTGACCTGGT | 1079 |
| GTTTTCCTGCTCCCAGTCTG | 1080 |
| TGTTTTCCTGCTCCCAGTCT | 1081 |
| CTGTTTTCCTGCTCCCAGTC | 1082 |
| TCTGTTTTCCTGCTCCCAGT | 1083 |
| AGCAGTTCTTGGCCCTTGGG | 1084 |
| CACCCTGGCCCTACAGACCT | 1085 |
| ACCCACACAGGCCCACTGCA | 1086 |
| GAGCTACCTGGACCAGCCCA | 1087 |
| ATTGTCCTCCAGCTCTCAGC | 1088 |
| GGCCCTACAGACCTGTGTCT | 1089 |
| GCCACAGGCTAGCTTGACCC | 1090 |
| GGCTGGTTTGCCTCAACCCT | 1091 |
| CTCTGGGTGTCTTGTCCCAG | 1092 |
| ACAGCTTCTCCAGCCTCTGG | 1093 |
| TCCAGAGCCATGTCCCTGGA | 1094 |
| ATGCCTCTCTTCATGGGCCT | 1095 |
| TCCTTGGCTATGGCCTACCC | 1096 |
| GGCCCACTGCAGGACAGGTG | 1097 |
| CCAGGCCTAGGTGCTTGACC | 1098 |
| CTGGTGCCTTGGGCTTTGGG | 1099 |
| ACCTGGTTAGTGCCAGCCTT | 1100 |
| TGCCTCTCTTCATGGGCCTG | 1101 |
| AAGCTGCTGGGCTGGGCAGG | 1102 |
| GCCACTTCTGAGTCCTCTGT | 1103 |
| GGACCAGCCCACCCCAGTAA | 1104 |
| GCTCTCTTTTCTGCTGTGGC | 1105 |
| TCCCCTGGCTGAAGAGTGCC | 1106 |

-continued

| | |
|---|---|
| AGTTGTGGCTGGGCCACAGG | 1107 |
| TCCTCTTCTCCTCCCAACCA | 1108 |
| AAGCCCAGCCCACAGCAGGA | 1109 |
| GAAGCCCAGCCCACAGCAGG | 1110 |
| TGCCCCTCTCCTTGCAGATG | 1111 |
| AGTTCCAGCAGTTTCCCCAG | 1112 |
| GCACAGCCCCAACCAGGTTC | 1113 |
| GACCCAGCCTCTGTCTAGGA | 1114 |
| GGTACCTGGTTAGTGCCAGC | 1115 |
| GGATCTGGCTGACTCAGCCC | 1116 |
| CTCCAGCCTCTGGGTCTTTA | 1117 |
| GGCCTTGGCTTAGAGGAGGC | 1118 |
| AGCTACCTGGACCAGCCCAC | 1119 |
| AGAGCTACCTGGACCAGCCC | 1120 |
| TCAGCTAGTTGTGGCTGGGC | 1121 |
| GGGTTCTGGTGTCCCCAGAA | 1122 |
| GGCCTAGGTGCTTGACCTGG | 1123 |
| CCCAGCCTCTGTCTAGGATC | 1124 |
| CCTTGGCTATGGCCTACCCA | 1125 |
| GCTGGTTTGCCTCAACCCTC | 1126 |
| CTGCACAGCCCCAACCAGGT | 1127 |
| GGCCACAGGCTAGCTTGACC | 1128 |
| CTGCAGCCCAGCCAAGCAGA | 1129 |
| CAGGCCAGAGGAGAGGTCCT | 1130 |
| TTCCTGCTCTGTATGGCCTC | 1131 |
| AGGCACCACCCCATCCACAG | 1132 |
| TCTGGTGCCTTGGGCTTTGG | 1133 |
| CCCCTGGCTGAAGAGTGCCA | 1134 |
| ACCCTGGCCCTACAGACCTG | 1135 |
| CCACACAGGCCCACTGCAGG | 1136 |
| CTTCTGGTGCCTTGGGCTTT | 1137 |
| TACCTGGTTAGTGCCAGCCT | 1138 |
| CAGAGCCCACTGTGGGTTCT | 1139 |
| GAGCAGTTCTTGGCCCTTGG | 1140 |
| AGTCAGTTCTCCCTTTCTGC | 1141 |
| CACTGTGGGTTCTGGTGTCC | 1142 |
| CTGGGTCTTTATGCCCCAGT | 1143 |
| GGCCAGAGGAGAGGTCCTGA | 1144 |
| TCTCTTTTCTGCTGTGGCCT | 1145 |
| CTCTCTTTTCTGCTGTGGCC | 1146 |

-continued

| | |
|---|---|
| AGCCTCTGGGTCTTTATGCC | 1147 |
| TGTGTTCTCTCTCCCAGTTC | 1148 |
| GGCCACTTCTGAGTCCTCTG | 1149 |
| GTCATATCCATGCCCTGGCT | 1150 |
| GTTTCCTCTTCTCCTCCCAA | 1151 |
| CACAGCCCCAACCAGGTTCC | 1152 |
| GGTGCTCTCTTTTCTGCTGT | 1153 |
| TGGTTAGTGCCAGCCTTGGG | 1154 |
| GCCTAATCCTCCAGGAGCCA | 1155 |
| TCCCAGCACTTTCTCTGTGC | 1156 |
| CTCTGGGTCTTTATGCCCCA | 1157 |
| ACCAAGGCACCACCCCATCC | 1158 |
| TGGGTCTTTATGCCCCAGTC | 1159 |
| CCTGCTCTGTATGGCCTCTG | 1160 |
| TATCCATGCCCTGGCTCTGG | 1161 |
| GGAGTCAGTTCTCCCTTTCT | 1162 |
| TACCCTCTGGGTGTCTTGTC | 1163 |
| GTATGGGTGGCAGTCACCTC | 1164 |
| GAAGCTGCTGGGCTGGGCAG | 1165 |
| AGAAGCTGCTGGGCTGGGCA | 1166 |
| GTTCTCCCTTTCTGCTATCC | 1167 |
| AAGGCTGTGTTCTCTCTCCC | 1168 |
| GTCCCTGGATATTGTCCTCC | 1169 |
| GCCCCAACCAGGTTCCCAAC | 1170 |
| GTCAGCTAGTTGTGGCTGGG | 1171 |
| TCTTTTCTGCTGTGGCCTGT | 1172 |
| GTCTCAGGAGAAGCCAGGCC | 1173 |
| GAGCTGCCTGGTGGATTGGT | 1174 |
| ACCCCACAGGCCAGAGGAGA | 1175 |
| TGCTCTGTATGGCCTCTGGG | 1176 |
| GTCACTTCTCCAGACAGGCC | 1177 |
| CCTCTTCTCCTCCCAACCAG | 1178 |
| GTCCTAGTATGGGTGGCAGT | 1179 |
| CAGGCCTAGGTGCTTGACCT | 1180 |
| CCAGAGCCATGTCCCTGGAT | 1181 |
| CTGAGCAGTTCTTGGCCCTT | 1182 |
| CCTGGCCCTACAGACCTGTG | 1183 |
| GGCTGCCTAATCCTCCAGGA | 1184 |
| AGCCCCAACCAGGTTCCCAA | 1185 |

-continued

| | |
|---|---|
| CTCCCCTGGCTGAAGAGTGC | 1186 |
| ACCCAGCCTCTGTCTAGGAT | 1187 |
| GGGCCACAGGCTAGCTTGAC | 1188 |
| GTGTTGCCTTTGCTGTGGTT | 1189 |
| GAAGCCAGGCCTAGGTGCTT | 1190 |
| CTGGCCCTACAGACCTGTGT | 1191 |
| CTAGTTGTGGCTGGGCCACA | 1192 |
| CCCCACAGGCCAGAGGAGAG | 1193 |
| CAGGCCCACTGCAGGACAGG | 1194 |
| GTGGTACCTGGTTAGTGCCA | 1195 |
| AGAAGCCAGGCCTAGGTGCT | 1196 |
| GCCAGCCTTGGGAAGGAGGG | 1197 |
| AAGTTTCCTCTTCTCCTCCC | 1198 |
| TGACCCAGCCTCTGTCTAGG | 1199 |
| GTCTTTATGCCCCAGTCTGG | 1200 |
| GGTCTTTATGCCCCAGTCTG | 1201 |
| TGGCCCTACAGACCTGTGTC | 1202 |
| GGGCAGTGCTCTCTTTGGAC | 1203 |
| GGTGCCATACAGAGCCCACT | 1204 |
| TCCAGACAGGCCTTGAGGGT | 1205 |
| AACCTTCTGGTGCCTTGGGC | 1206 |
| CCTGAGCTGCCTGGTGGATT | 1207 |
| AGGCCAGAGGAGAGGTCCTG | 1208 |
| TGGCTATGGCCTACCCACTC | 1209 |
| TCTGGTGCCATACAGAGCCC | 1210 |
| TGCACAGCCCCAACCAGGTT | 1211 |
| TCTGGCTGACTCAGCCCCAA | 1212 |
| TCACTCTACCCAGCCACTCT | 1213 |
| ACAGGCCAGAGGAGAGGTCC | 1214 |
| CTGCTCTGTATGGCCTCTGG | 1215 |
| CCAGCCTCTGTCTAGGATCT | 1216 |
| GGACCTCAGGAGGGAGTGGG | 1217 |
| AGAGCCCACTGTGGGTTCTG | 1218 |
| AGGGCAGTGCTCTCTTTGGA | 1219 |
| TGCCTAATCCTCCAGGAGCC | 1220 |
| ACAGAGCCCACTGTGGGTTC | 1221 |
| AGGGCTGGTTTGCCTCAACC | 1222 |
| CCACTGCAGGACAGGTGGCA | 1223 |
| GAGAAGCCAGGCCTAGGTGC | 1224 |
| TACCCACTCCCCTGGCTGAA | 1225 |

-continued

| | |
|---|---|
| TTTTCCAGAGCCATGTCCCT | 1226 |
| TTCCAGCAGTTTCCCCAGAG | 1227 |
| TCCAGCCTCTGGGTCTTTAT | 1228 |
| GACAGGAGTCAGTTCTCCCT | 1229 |
| TGGGCCACAGGCTAGCTTGA | 1230 |
| ATGGGTGGCAGTCACCTCTG | 1231 |
| CATATCCATGCCCTGGCTCT | 1232 |
| GGAGGGCTGGTTTGCCTCAA | 1233 |
| GCCCTACAGACCTGTGTCTG | 1234 |
| GTTGCCTTTGCTGTGGTTGG | 1235 |
| ATTCCTGCTCTGTATGGCCT | 1236 |
| CCCACAGGCCAGAGGAGAGG | 1237 |
| AGACAGGCCTTGAGGGTTCC | 1238 |
| CTGGTGCCATACAGAGCCCA | 1239 |
| GGGCAGAGGATCATGCCACC | 1240 |
| TCTGGGTCTTTATGCCCCAG | 1241 |
| TTACCCTCTGGGTGTCTTGT | 1242 |
| GTCTAAGGGCAGTGCTCTCT | 1243 |
| TCATATCCATGCCCTGGCTC | 1244 |
| AGGCCTAGGTGCTTGACCTG | 1245 |
| AGTATGGGTGGCAGTCACCT | 1246 |
| TCTGAGTCCTCTGTCTCAGG | 1247 |
| AGACCTGTGTCTGAGCAGGC | 1248 |
| CCTCAGGAGGGAGTGGGACT | 1249 |
| TATGGGTGGCAGTCACCTCT | 1250 |
| GCAGTCATCAGCCATTCCTT | 1251 |
| CACAGGCCCACTGCAGGACA | 1252 |
| AGCAGTCATCAGCCATTCCT | 1253 |
| AACCCACACAGGCCCACTGC | 1254 |
| CTCTTTTCTGCTGTGGCCTG | 1255 |
| GCAGAACACCCTGGCCCTAC | 1256 |
| AGGAGTCAGTTCTCCCTTTC | 1257 |
| TCACTTCTCCAGACAGGCCT | 1258 |
| CTTCAGGGACCAGAGGCAGC | 1259 |
| TTCTGGTGCCTTGGGCTTTG | 1260 |
| GGTTCTGGTGTCCCCAGAAT | 1261 |
| TGTGGTACCTGGTTAGTGCC | 1262 |
| GACCAAGGCACCACCCCATC | 1263 |
| TGGCTGCCTAATCCTCCAGG | 1264 |

-continued

| | |
|---|---|
| TCTGGTGTCCCCAGAATCCA | 1265 |
| TGTCAACACCTGGCCCTTGC | 1266 |
| GCTGCCTGGTGGATTGGTAC | 1267 |
| GAGACCAAGGCACCACCCCA | 1268 |
| CAGGTGCTCTCTTTTCTGCT | 1269 |
| CTGGCTGACTCAGCCCCAAC | 1270 |
| GCAAGGCTGTGTTCTCTCTC | 1271 |
| AAGCCAGGCCTAGGTGCTTG | 1272 |
| ACTGCACAGCCCCAACCAGG | 1273 |
| CCAGACAGGCCTTGAGGGTT | 1274 |
| AGCAGAACACCCTGGCCCTA | 1275 |
| TTGGCTATGGCCTACCCACT | 1276 |
| CTTGGCTATGGCCTACCCAC | 1277 |
| GGCAGAGGATCATGCCACCT | 1278 |
| ATCCTTGGCTATGGCCTACC | 1279 |
| GCCAGAGGAGAGGTCCTGAG | 1280 |
| TGTCCCTGAGCAGTTCTTGG | 1281 |
| TAGTTGTGGCTGGGCCACAG | 1282 |
| TCCTAGTATGGGTGGCAGTC | 1283 |
| ACACAGGCCCACTGCAGGAC | 1284 |
| AGCTGCCTGGTGGATTGGTA | 1285 |
| CTCCAGACAGGCCTTGAGGG | 1286 |
| CTTTTCTGCTGTGGCCTGTG | 1287 |
| GGGTGGCAGTCACCTCTGAA | 1288 |
| TTGCCTTTGCTGTGGTTGGG | 1289 |
| ACAGGAGTCAGTTCTCCCTT | 1290 |
| GACCTCAGGAGGGAGTGGGA | 1291 |
| CCTTGAGGGTTCCCCACATG | 1292 |
| GGCCAGGAAGCTTTGTCAGC | 1293 |
| GCCTGTGTGAATAGCCTGGC | 1294 |
| GCTGGACTCTGATTCCCTCA | 1295 |
| GTGCTGGGTTCTGTCAGATC | 1296 |
| TCAGTTCTCCCTTTCTGCTA | 1297 |
| CAGCCTCTGGGTCTTTATGC | 1298 |
| CTCTTCTCCTCCCAACCAGA | 1299 |
| AGGATCTGGCTGACTCAGCC | 1300 |
| AGGAGAAGCCAGGCCTAGGT | 1301 |
| GTGCCAGCCTTGGGAAGGAG | 1302 |
| AGTGCCAGCCTTGGGAAGGA | 1303 |
| ACAGGCCCACTGCAGGACAG | 1304 |

-continued

| | |
|---|---|
| CTCTGGTGCCATACAGAGCC | 1305 |
| TCAGGGACCAGAGGCAGCAC | 1306 |
| CAGGAGTCAGTTCTCCCTTT | 1307 |
| TCCCTGGATATTGTCCTCCA | 1308 |
| ACTCTACCCAGCCACTCTGA | 1309 |
| TGAGCAGTTCTTGGCCCTTG | 1310 |
| TTCTGGTGTCCCCAGAATCC | 1311 |
| GGGCTGGATGCTGGACTCTG | 1312 |
| GCAACTGGAGGTCTGCAGCT | 1313 |
| CTGCCTAATCCTCCAGGAGC | 1314 |
| GCTGCCTAATCCTCCAGGAG | 1315 |
| CTGCCTGGTGGATTGGTACC | 1316 |
| TTTCCTCTTCTCCTCCCAAC | 1317 |
| TTCAGGGACCAGAGGCAGCA | 1318 |
| TCTTTATGCCCCAGTCTGGA | 1319 |
| CACTCTACCCAGCCACTCTG | 1320 |
| GTTCTGGTGTCCCCAGAATC | 1321 |
| GTGTCAACACCTGGCCCTTG | 1322 |
| TGGTGCCATACAGAGCCCAC | 1323 |
| CAAGGCTGTGTTCTCTCTCC | 1324 |
| GTGTCTGAGCAGGCTTTGGA | 1325 |
| CCTAGTATGGGTGGCAGTCA | 1326 |
| GGCTAGATCAGCAATGCCCC | 1327 |
| CACTCCCCTGGCTGAAGAGT | 1328 |
| GGAGAAGCCAGGCCTAGGTG | 1329 |
| CCTAGGTGCTTGACCTGGTG | 1330 |
| GCCAGGAAGCTTTGTCAGCT | 1331 |
| GTGCTCTCTTTTCTGCTGTG | 1332 |
| CCTGATCTGCCTGGACCAGA | 1333 |
| ACTGTGGGTTCTCCTGGTAT | 1334 |
| CTCCTTCCAGCCCAAACTGC | 1335 |
| CCCCAACCAGGTTCCCAACA | 1336 |
| CCTGTGTGAATAGCCTGGCC | 1337 |
| ACCTCAGGAGGGAGTGGGAC | 1338 |
| GAGTCAGTTCTCCCTTTCTG | 1339 |
| AGACCAAGGCACCACCCCAT | 1340 |
| TCTCCAGACAGGCCTTGAGG | 1341 |
| ATTTTCCAGAGCCATGTCCC | 1342 |
| CCAGCCTCTGGGTCTTTATG | 1343 |

-continued

| | |
|---|---|
| CACTTCTCCAGACAGGCCTT | 1344 |
| GTCTGAGCAGGCTTTGGAGG | 1345 |
| CCAGCCCAAACTGCACAGCC | 1346 |
| GTGGCCTGTGTGAATAGCCT | 1347 |
| GGTCTCTCACAGGATGCTGG | 1348 |
| TGTCAGCTAGTTGTGGCTGG | 1349 |
| TGCCAGCCTTGGGAAGGAGG | 1350 |
| GGTGCTTGACCTGGTGATCT | 1351 |
| CCTGGTGATCTGAGCTGTGT | 1352 |
| TGGCAAGGCTGTGTTCTCTC | 1353 |
| AGGTGCTCTCTTTTCTGCTG | 1354 |
| GACCAGCCCACCCCAGTAAA | 1355 |
| GAGGGCTGGTTTGCCTCAAC | 1356 |
| GTGTAGCAGTCATCAGCCAT | 1357 |
| GCCATACAGAGCCCACTGTG | 1358 |
| TGCCATACAGAGCCCACTGT | 1359 |
| GTGCCATACAGAGCCCACTG | 1360 |
| GGAATCCTTACCCTCTGGGT | 1361 |
| GATGGCTGCCTAATCCTCCA | 1362 |
| TACAGAGCCCACTGTGGGTT | 1363 |
| ACAGGTGCTCTCTTTTCTGC | 1364 |
| TTTCCCAGCACTTTCTCTGT | 1365 |
| CCAGCCTTGGGAAGGAGGGA | 1366 |
| GTTAGTGCCAGCCTTGGGAA | 1367 |
| CACAGGCCAGAGGAGAGGTC | 1368 |
| CTGGTGTCCCCAGAATCCAT | 1369 |
| GGAGGCTTGTGACTTCAGCT | 1370 |
| GGCTTGGTGATCTCTGGAGG | 1371 |
| GGGCTTGGTGATCTCTGGAG | 1372 |
| CAGCCCACCCCAGTAAATCC | 1373 |
| CCAGCCCACCCCAGTAAATC | 1374 |
| TGCTGGACTCTGATTCCCTC | 1375 |
| CCTGTGTCACTTCTCCAGAC | 1376 |
| ATCCTCCAGGAGCCATTTTC | 1377 |
| AAGCAGAACACCCTGGCCCT | 1378 |
| AACCCCACAGGCCAGAGGAG | 1379 |
| TGGTACCTGGTTAGTGCCAG | 1380 |
| TATTGTCCTCCAGCTCTCAG | 1381 |
| ATACAGAGCCCACTGTGGGT | 1382 |
| AACAGCTTCTCCAGCCTCTG | 1383 |

-continued

| | |
|---|---|
| TGCAGGACAGGTGGCAGAGG | 1384 |
| TGCTCTCTTTTCTGCTGTGG | 1385 |
| TGTCTAAGGGCAGTGCTCTC | 1386 |
| AAGGCCACTTCTGAGTCCTC | 1387 |
| TGAGCTGCCTGGTGGATTGG | 1388 |
| GGCTGGATGCTGGACTCTGA | 1389 |
| GGAGAGGTCCTGAGAGAGGT | 1390 |
| CTGGTCTCTCACAGGATGCT | 1391 |
| GCCAAGCAGAACACCCTGGC | 1392 |
| GATATTGTCCTCCAGCTCTC | 1393 |
| TATTCCTGCTCTGTATGGCC | 1394 |
| TGTCCCTGGATATTGTCCTC | 1395 |
| CTCAGGAGAAGCCAGGCCTA | 1396 |
| CCTAATCCTCCAGGAGCCAT | 1397 |
| ACCAGAAGGCCACACAGGGC | 1398 |
| CAGACAGGCCTTGAGGGTTC | 1399 |
| GGCCTGTGTGAATAGCCTGG | 1400 |
| GCAGATGGCTGCCTAATCCT | 1401 |
| AATCCTTACCCTCTGGGTGT | 1402 |
| ACTCCCCTGGCTGAAGAGTG | 1403 |
| TTGTCCTAGTATGGGTGGCA | 1404 |
| ACTGGCCTTGGCTTAGAGGA | 1405 |
| TGTCTCAGGAGAAGCCAGGC | 1406 |
| GGTTCAGGAGAGCTACCTGG | 1407 |
| TGCTTGGCAAGGCTGTGTTC | 1408 |
| ATATTGTCCTCCAGCTCTCA | 1409 |
| TGTCCTAGTATGGGTGGCAG | 1410 |
| GGGAGGATCTGGCTGACTCA | 1411 |
| AGATGGCTGCCTAATCCTCC | 1412 |
| CAGTTCTCCCTTTCTGCTAT | 1413 |
| GGCTTGTGACTTCAGCTGTT | 1414 |
| TCTGGTCTCTCACAGGATGC | 1415 |
| TGTCACTTCTCCAGACAGGC | 1416 |
| GCTAGATCAGCAATGCCCCA | 1417 |
| CTGTGGGTTCTCCTGGTATA | 1418 |
| TAGTATGGGTGGCAGTCACC | 1419 |
| GGTGGCAGTCACCTCTGAAC | 1420 |
| TGTTGCCTTTGCTGTGGTTG | 1421 |
| GCAGAGGATCATGCCACCTT | 1422 |

-continued

| | |
|---|---|
| GGAGGTTCAGGAGAGCTACC | 1423 |
| AGGCTTGTGACTTCAGCTGT | 1424 |
| TAGTGCCAGCCTTGGGAAGG | 1425 |
| GATTGGGTAATGCAGGGCCC | 1426 |
| CACTGGCCTTGGCTTAGAGG | 1427 |
| CCCTACAGACCTGTGTCTGA | 1428 |
| AGCAACTGGAGGTCTGCAGC | 1429 |
| GATCCTTGGCTATGGCCTAC | 1430 |
| TAGCAGTCATCAGCCATTCC | 1431 |
| CAGAGCCATGTCCCTGGATA | 1432 |
| ATGGCTGCCTAATCCTCCAG | 1433 |
| TGTGCTGGGTTCTGTCAGAT | 1434 |
| ATGTGCTGGGTTCTGTCAGA | 1435 |
| CTGGCCTTGGCTTAGAGGAG | 1436 |
| TGTGTCTGAGCAGGCTTTGG | 1437 |
| GTGAATAGCCTGGCCATGCT | 1438 |
| ACTTCTCCAGACAGGCCTTG | 1439 |
| CTTGAGGGTTCCCCACATGA | 1440 |
| ATCCTCCTCAAGCTGACTGC | 1441 |
| CAAGCAGAACACCCTGGCCC | 1442 |
| CCAAGCAGAACACCCTGGCC | 1443 |
| ACCAGCCCACCCCAGTAAAT | 1444 |
| AGAAGGCCACACAGGGCAGT | 1445 |
| GTCTCTCACAGGATGCTGGA | 1446 |
| TAACCCCACAGGCCAGAGGA | 1447 |
| GTAGCAGTCATCAGCCATTC | 1448 |
| GAGAGACCAAGGCACCACCC | 1449 |
| GACCTGGTGATCTGAGCTGT | 1450 |
| CAGGAGAAGCCAGGCCTAGG | 1451 |
| TTGGCAAGGCTGTGTTCTCT | 1452 |
| ATCTGAGCTGTGTTTGTCCT | 1453 |
| GAGGATCTGGCTGACTCAGC | 1454 |
| CACTTCAGGGACCAGAGGCA | 1455 |
| GTGTCCCCAGAATCCATGTG | 1456 |
| TCTAAGGGCAGTGCTCTCTT | 1457 |
| ATGGCAGCTTCATTCCTGGA | 1458 |
| CTTTCTCTGTGCCCAGAGAT | 1459 |
| GGGAGACTGGTTTCAGGAGC | 1460 |
| TTTGTCCTAGTATGGGTGGC | 1461 |
| TGCTGGGTTCTGTCAGATCA | 1462 |

-continued

CCCTTTCTGCTATCCATCAC                              1463

GCTTGGTGATCTCTGGAGGA                              1464

TCAGGAGAGCTACCTGGACC                              1465

CTGCTGTGGCCTGTGTGAAT                              1466

TCACAGGTGCTCTCTTTTCT                              1467

CAGACCTGTGTCTGAGCAGG                              1468

TCCAGCCCAAACTGCACAGC                              1469

GAGGTTCAGGAGAGCTACCT                              1470

AGGTGCTTGACCTGGTGATC                              1471

CCATACAGAGCCCACTGTGG                              1472

GTGTTTGTCCTAGTATGGGT                              1473

AAGGGCAGTGCTCTCTTTGG                              1474

CATTGCTGCTTGGCAAGGCT                              1475

TTTGTCAGCTAGTTGTGGCT                              1476

CTTTGTCAGCTAGTTGTGGC                              1477

GCTTTGTCAGCTAGTTGTGG                              1478

GCCTCTGTCTAGGATCTAGA                              1479

TGGATATTGTCCTCCAGCTC                              1480

CCCTGGCTGAAGAGTGCCAA                              1481

TGGGCAGAGGATCATGCCAC                              1482

GTGTCACTTCTCCAGACAGG                              1483

TCAACTCACTCTACCCAGCC                              1484

AGGAGCCATTTTCCAAGGGC                              1485

GCTTGTGACTTCAGCTGTTC                              1486

TTGTCTAAGGGCAGTGCTCT                              1487

CTTGTCTAAGGGCAGTGCTC                              1488

TCTTGTCTAAGGGCAGTGCT                              1489

CTCTTGTCTAAGGGCAGTGC                              1490

CTAGGTGCTTGACCTGGTGA                              1491

TGAGCTGTGTTTGTCCTAGT                              1492

ATGCTGGACTCTGATTCCCT                              1493

AGGAGGCTTGTGACTTCAGC                              1494

GGCTTAGAGGAGGCTTGTGA                              1495

ACACTTCAGGGACCAGAGGC                              1496

TGTGGCCTGTGTGAATAGCC                              1497

TCTGAGCAGGCTTTGGAGGA                              1498

TTCTCCAGACAGGCCTTGAG                              1499

CAGCCTCTGTCTAGGATCTA                              1500

GCCCACAATGGGCAGAGGAT                              1501

-continued

| | |
|---|---|
| GTTCAGGAGAGCTACCTGGA | 1502 |
| GAGCCATGTCCCTGGATATT | 1503 |
| GATCTGAGCTGTGTTTGTCC | 1504 |
| CCAGCCAAGCAGAACACCCT | 1505 |
| CAGGAGAGCTACCTGGACCA | 1506 |
| CTGTGTGAATAGCCTGGCCA | 1507 |
| GGATTTGCAGTCAGCAGAGC | 1508 |
| CACACTGGCCTTGGCTTAGA | 1509 |
| GTTGGGATTTGCAGTCAGCA | 1510 |
| AGAGCCATGTCCCTGGATAT | 1511 |
| AACTGTGGGTTCTCCTGGTA | 1512 |
| TGCCCACAATGGGCAGAGGA | 1513 |
| ACTCTGGTGCCATACAGAGC | 1514 |
| GCTGACTGCTATCAGCAGGA | 1515 |
| CTCAGGAGGGAGTGGGACTG | 1516 |
| GTGTGGCTGGACTTTTGACC | 1517 |
| TCAGGAGAAGCCAGGCCTAG | 1518 |
| ACTTCAGGGACCAGAGGCAG | 1519 |
| TTGTCAGCTAGTTGTGGCTG | 1520 |
| CCCCAGAATCCATGTGTCTT | 1521 |
| CCCAACCAGGTTCCCAACAC | 1522 |
| TGGGTCAGCTTTTTGTTGCA | 1523 |
| ATGTCCCTGGATATTGTCCT | 1524 |
| ATGTGGTACCTGGTTAGTGC | 1525 |
| GTGGCAGTCACCTCTGAACA | 1526 |
| GAGCTGTGTTTGTCCTAGTA | 1527 |
| TCTTTTTCCATCTGTCCTGG | 1528 |
| TCATCCTCCTCAAGCTGACT | 1529 |
| GTTTGTCCTAGTATGGGTGG | 1530 |
| ACTGGTTTCAGGAGCTGTTC | 1531 |
| GATGCTGGACTCTGATTCCC | 1532 |
| CTTGTGACTTCAGCTGTTCC | 1533 |
| CATACAGAGCCCACTGTGGG | 1534 |
| GAATCCTTACCCTCTGGGTG | 1535 |
| CTTCTGTTGGGTTGTTGCAC | 1536 |
| ACTTCTGTTGGGTTGTTGCA | 1537 |
| CTAGTATGGGTGGCAGTCAC | 1538 |
| GGTGGAGGAAGGATCAGGCT | 1539 |
| TGCAGATGGCTGCCTAATCC | 1540 |
| CCCAAACTGCACAGCCCCAA | 1541 |

-continued

```
TGTCTGAGCAGGCTTTGGAG                                1542

GTGCTTGACCTGGTGATCTG                                1543

TGGTCTCTCACAGGATGCTG                                1544

GAGGATCATGCCACCTTGGA                                1545

CTAAGGGCAGTGCTCTCTTT                                1546

TCAGGAGGGAGTGGGACTGA                                1547

ACACACTGGCCTTGGCTTAG                                1548

ACCTGGTGATCTGAGCTGTG                                1549

AGGAGAGCTACCTGGACCAG                                1550

AGCCTCTGTCTAGGATCTAG                                1551

TCATCCCCTGGAGATACTCA                                1552

ACACTGGCCTTGGCTTAGAG                                1553

TTGGCTTAGAGGAGGCTTGT                                1554

CTGTGTCACTTCTCCAGACA                                1555

GAATAGCCTGGCCATGCTGA                                1556

CTGGACTCTGATTCCCTCAG                                1557

ACATTGCTGCTTGGCAAGGC                                1558

GGGTTCTCCTGGTATATCTA                                1559

TTGCCCACAATGGGCAGAGG                                1560

GGCTAACATTGCTGCTTGGC                                1561

TGTGAATAGCCTGGCCATGC                                1562

GAGGCTTGTGACTTCAGCTG                                1563

GTGGCTGGACTTTTGACCTT                                1564

TTAGTGCCAGCCTTGGGAAG                                1565

AACTGCACAGCCCCAACCAG                                1566

GAGGTCCTGAGAGAGGTGAC                                1567

AGGTTCAGGAGAGCTACCTG                                1568

TCTTCTCCTCCCAACCAGAA                                1569

GCTGGATGCTGGACTCTGAT                                1570

GGAGGATCTGGCTGACTCAG                                1571

GGACTCTGATTCCCTCAGAG                                1572

TGTAGCAGTCATCAGCCATT                                1573

GCCCACAGCAGGACAAGCAA                                1574

TTTGCAGTCAGCAGAGCACA                                1575

GAGATACTTCCCACTTCCTC                                1576

GACAGAGACTCTGGTGCCAT                                1577

CAGATGGCTGCCTAATCCTC                                1578

AGCTGACTGCTATCAGCAGG                                1579

ACTTCCCACTTCCTCATACA                                1580
```

-continued

| | |
|---|---|
| TGGCCTGTGTGAATAGCCTG | 1581 |
| CTTTATGCCCCAGTCTGGAA | 1582 |
| CAGTCATCAGCCATTCCTTA | 1583 |
| AGGTCCTGAGAGAGGTGACA | 1584 |
| TGACAGAGACTCTGGTGCCA | 1585 |
| CATAACCCACACAGGCCCAC | 1586 |
| TGGAATCCTTACCCTCTGGG | 1587 |
| AGATACTTCCCACTTCCTCA | 1588 |
| AAAGTTTCCTCTTCTCCTCC | 1589 |
| TTGTGACTTCAGCTGTTCCA | 1590 |
| CTGGTGATCTGAGCTGTGTT | 1591 |
| TCCCCTGGAGATACTCAGAC | 1592 |
| GGCAGAGGAGCTATTTGGGA | 1593 |
| AGAGGTCCTGAGAGAGGTGA | 1594 |
| GAGAGGTCCTGAGAGAGGTG | 1595 |
| CCCCAGTAAATCCTGTGTCA | 1596 |
| CACAGGTGCTCTCTTTTCTG | 1597 |
| TGGCTTAGAGGAGGCTTGTG | 1598 |
| GAACACACTGGCCTTGGCTT | 1599 |
| TTCTGTTGGGTTGTTGCACA | 1600 |
| TGGACTCTGATTCCCTCAGA | 1601 |
| GGATGCTGGACTCTGATTCC | 1602 |
| GATTTGCAGTCAGCAGAGCA | 1603 |
| CTGTGGCCTGTGTGAATAGC | 1604 |
| ACAGACCTGTGTCTGAGCAG | 1605 |
| AATAGCCTGGCCATGCTGAC | 1606 |
| GATACTTCCCACTTCCTCAT | 1607 |
| CTAATCCTCCAGGAGCCATT | 1608 |
| CTACAGACCTGTGTCTGAGC | 1609 |
| GAGGAGGTTCAGGAGAGCTA | 1610 |
| TTGGGACAGGAGTCAGTTCT | 1611 |
| CATCTTTTTCCATCTGTCCT | 1612 |
| GGGCAGTGGACAACAGTGGA | 1613 |
| AGGAGAGGTCCTGAGAGAGG | 1614 |
| AGAGGATCATGCCACCTTGG | 1615 |
| TTTATGTGCTGGGTTCTGTC | 1616 |
| GGCAGTCACCTCTGAACACA | 1617 |
| CCAGGAGCCATTTTCCAAGG | 1618 |
| CCCACTTCCTCATACATTCT | 1619 |
| CTTCCCACTTCCTCATACAT | 1620 |

-continued

| | |
|---|---|
| AAACCTTCTGGTGCCTTGGG | 1621 |
| CCCCTGGAGATACTCAGACA | 1622 |
| TAGGTGCTTGACCTGGTGAT | 1623 |
| GCCCCAGTCTGGAAACATTC | 1624 |
| AGCTGTGTTTGTCCTAGTAT | 1625 |
| CCATGCTCATAATGGAGCCC | 1626 |
| CCCATGCTCATAATGGAGCC | 1627 |
| TCTGTTGGGTTGTTGCACAT | 1628 |
| TATTTTCCAGAGCCATGTCC | 1629 |
| AAACTGTGGGTTCTCCTGGT | 1630 |
| GTGTGAATAGCCTGGCCATG | 1631 |
| TGTGTGAATAGCCTGGCCAT | 1632 |
| GGATCATGCCACCTTGGATT | 1633 |
| ACCCCAGTAAATCCTGTGTC | 1634 |
| TGAACACACTGGCCTTGGCT | 1635 |
| ATCCCCTGGAGATACTCAGA | 1636 |
| ATCATCCCCTGGAGATACTC | 1637 |
| GCTTAGAGGAGGCTTGTGAC | 1638 |
| TGCTGTGGCCTGTGTGAATA | 1639 |
| CACCTCTGAACACACTGGCC | 1640 |
| CTGGGTTCTGTCAGATCACA | 1641 |
| AGGATCATGCCACCTTGGAT | 1642 |
| GGGTTCCCCACATGAAATCC | 1643 |
| AAGAGTGTTGCCTTTGCTGT | 1644 |
| TCTGTCTCAGGAGAAGCCAG | 1645 |
| AGCCAAGCAGAACACCCTGG | 1646 |
| CATCCTCCTCAAGCTGACTG | 1647 |
| CATCCCCTGGAGATACTCAG | 1648 |
| TCCCACTTCCTCATACATTC | 1649 |
| GTGGCAGAGGAGCTATTTGG | 1650 |
| CCAAGCAACTGGAGGTCTGC | 1651 |
| CCCAGAATCCATGTGTCTTC | 1652 |
| AGCTTTGTCAGCTAGTTGTG | 1653 |
| GCTCATAATGGAGCCCTTTC | 1654 |
| CCACACAGGGCAGTGGACAA | 1655 |
| CCTACAGACCTGTGTCTGAG | 1656 |
| AATCCTCCAGGAGCCATTTT | 1657 |
| ATTCCTGGAATCCTTACCCT | 1658 |
| GCTGTGTTTGTCCTAGTATG | 1659 |

-continued

| | |
|---|---|
| TTGACCTGGTGATCTGAGCT | 1660 |
| CTTGACCTGGTGATCTGAGC | 1661 |
| GCTTGACCTGGTGATCTGAG | 1662 |
| GTGATCTGAGCTGTGTTTGT | 1663 |
| TGAATAGCCTGGCCATGCTG | 1664 |
| ACTTATAACCCCACAGGCCA | 1665 |
| CACTTATAACCCCACAGGCC | 1666 |
| CTTGGCTTAGAGGAGGCTTG | 1667 |
| AGAGAGACCAAGGCACCACC | 1668 |
| ATATTCCTGCTCTGTATGGC | 1669 |
| CACCCCAGTAAATCCTGTGT | 1670 |
| ATTTGCAGTCAGCAGAGCAC | 1671 |
| GGAAGGCCAGGAAGCTTTGT | 1672 |
| AGCTTCATTCCTGGAATCCT | 1673 |
| GCTAACATTGCTGCTTGGCA | 1674 |
| CAGGAGGGAGTGGGACTGAT | 1675 |
| AAAGGCCACTTCTGAGTCCT | 1676 |
| CCCACAATGGGCAGAGGATC | 1677 |
| AGGAGGTTCAGGAGAGCTAC | 1678 |
| ATGACAGAGACTCTGGTGCC | 1679 |
| TACAGACCTGTGTCTGAGCA | 1680 |
| GCAGGCTTTGGAGGAAAGGC | 1681 |
| GTGACACTTCAGGGACCAGA | 1682 |
| GGGATATTCCTGCTCTGTAT | 1683 |
| GGGTCAGCTTTTTGTTGCAA | 1684 |
| TGATTGGGTAATGCAGGGCC | 1685 |
| CTTATAACCCCACAGGCCAG | 1686 |
| AGGGAAGGCCAGGAAGCTTT | 1687 |
| TGTGTCACTTCTCCAGACAG | 1688 |
| TGCTTGACCTGGTGATCTGA | 1689 |
| TCTTTTATGTGCTGGGTTCT | 1690 |
| GTGTCTTCATTCATTCACCT | 1691 |
| TCCAGGAGCCATTTTCCAAG | 1692 |
| GGCTTTGGAGGAAAGGCCAC | 1693 |
| GCAGAGGTCAACCAGAAGGC | 1694 |
| TGACCTGGTGATCTGAGCTG | 1695 |
| AGGGCAGTGGACAACAGTGG | 1696 |
| TTCAGGAGAGCTACCTGGAC | 1697 |
| CAGGAGCCATTTTCCAAGGG | 1698 |
| TGAGATACTTCCCACTTCCT | 1699 |

-continued

```
CTGAGATACTTCCCACTTCC                                1700

GGTCAACCAGAAGGCCACAC                                1701

GAGTGTGGCTGGACTTTTGA                                1702

TGGCAGAGGAGCTATTTGGG                                1703

TACTTCCCACTTCCTCATAC                                1704

AGAGCCAGAAATCATCCCCT                                1705

TAAGGGCAGTGCTCTCTTTG                                1706

TTCAACTCACTCTACCCAGC                                1707

GAGGTCAACCAGAAGGCCAC                                1708

GAGGAGGCTTGTGACTTCAG                                1709

AGAGGAGGCTTGTGACTTCA                                1710

GACCTTTAATGTCCCTGAGC                                1711

TCTGCCTGGACCAGAAGACA                                1712

GAAAGGCCACTTCTGAGTCC                                1713

AGGCTTTGGAGGAAAGGCCA                                1714

CAGGCTTTGGAGGAAAGGCC                                1715

GGGAAGGCCAGGAAGCTTTG                                1716

AATGGCAGCTTCATTCCTGG                                1717

TGGCAGTCACCTCTGAACAC                                1718

GGTGATCTGAGCTGTGTTTG                                1719

TGGTGATCTGAGCTGTGTTT                                1720

GAGGAGAGGTCCTGAGAGAG                                1721

TTGAGGGTTCCCCACATGAA                                1722

GACTCTGGTGCCATACAGAG                                1723

AGACTCTGGTGCCATACAGA                                1724

GAGACTCTGGTGCCATACAG                                1725

AGAGACTCTGGTGCCATACA                                1726

CAGAGACTCTGGTGCCATAC                                1727

ACAGAGACTCTGGTGCCATA                                1728

TTCCAGCCCAAACTGCACAG                                1729

CAGAGGATCATGCCACCTTG                                1730

TTATAACCCCACAGGCCAGA                                1731

TAATCCTCCAGGAGCCATTT                                1732

AGGTCAACCAGAAGGCCACA                                1733

CCTGGCTGAAGAGTGCCAAT                                1734

CTGTTGGGTTGTTGCACATT                                1735

ACCTTTAATGTCCCTGAGCA                                1736

GGAGGAAGAGTGTTGCCTTT                                1737

AGGAGGGAGTGGGACTGATT                                1738
```

-continued

| | |
|---|---|
| CTGATCTGCCTGGACCAGAA | 1739 |
| TTGGGATTTGCAGTCAGCAG | 1740 |
| AAACTGCACAGCCCCAACCA | 1741 |
| CAAACTGCACAGCCCCAACC | 1742 |
| GAGCCAGAAATCATCCCCTG | 1743 |
| AACACACTGGCCTTGGCTTA | 1744 |
| GCTATTTGGGACAGGAGTCA | 1745 |
| AGAGGTCAACCAGAAGGCCA | 1746 |
| CAGAGGTCAACCAGAAGGCC | 1747 |
| TTCCCACTTCCTCATACATT | 1748 |
| GGTTCCCCACATGAAATCCA | 1749 |
| AAACTCTCTCTCTGGTCTCT | 1750 |
| GAAGGCCAGGAAGCTTTGTC | 1751 |
| TGTTTGTCCTAGTATGGGTG | 1752 |
| TGTGTTTGTCCTAGTATGGG | 1753 |
| TCTCTGAGATACTTCCCACT | 1754 |
| CAGCCAAGCAGAACACCCTG | 1755 |
| GGTTCTGTCAGATCACATGT | 1756 |
| ATTGCCCACAATGGGCAGAG | 1757 |
| TTTGGGACAGGAGTCAGTTC | 1758 |
| TGCCCCAGTCTGGAAACATT | 1759 |
| GCAGAGGAGCTATTTGGGAC | 1760 |
| GATCTGCCTGGACCAGAAGA | 1761 |
| CCTTTAATGTCCCTGAGCAG | 1762 |
| ATACTTCCCACTTCCTCATA | 1763 |
| CATGCTCATAATGGAGCCCT | 1764 |
| ACAGGGCAGTGGACAACAGT | 1765 |
| AAGGCCAGGAAGCTTTGTCA | 1766 |
| AGTGGACAACAGTGGAGGGT | 1767 |
| GTGCCCAGAGATGTCAAGAG | 1768 |
| GGGAGTGGGACTGATTGGAG | 1769 |
| AGGGAGTGGGACTGATTGGA | 1770 |
| GAGGGAGTGGGACTGATTGG | 1771 |
| GGAGGGAGTGGGACTGATTG | 1772 |
| AGGGAGACTGGTTTCAGGAG | 1773 |
| AGTGTGGCTGGACTTTTGAC | 1774 |
| TGGAGGAAGAGTGTTGCCTT | 1775 |
| ACTCTTGTCTAAGGGCAGTG | 1776 |
| AATGGGCAGAGGATCATGCC | 1777 |
| GCAGTCACCTCTGAACACAC | 1778 |

-continued

| | |
|---|---|
| GGTTCTCCTGGTATATCTAT | 1779 |
| GCAGTCAGCAGAGCACAATT | 1780 |
| GAGAGGTGACACTTCAGGGA | 1781 |
| CATGCCACCTTGGATTTTCA | 1782 |
| GTGGAGGAAGGATCAGGCTA | 1783 |
| GCTAGGTGGAGGAAGGATCA | 1784 |
| ACAACAGAAGCTGCTGGGCT | 1785 |
| CTGAGCAGGCTTTGGAGGAA | 1786 |
| TCCTCCCAACCAGAAATGGC | 1787 |
| TGCTCATAATGGAGCCCTTT | 1788 |
| CCATCTGTCCTGGAATGAGG | 1789 |
| CTTTAATGTCCCTGAGCAGT | 1790 |
| GCTATCAGCAGGAGAAGGGA | 1791 |
| TGGCTGGACTTTTGACCTTT | 1792 |
| TCTTCAACTCACTCTACCCA | 1793 |
| TCTCTGAATACTGCCCTTGG | 1794 |
| GCAACTCTTGTCTAAGGGCA | 1795 |
| ATCCAAACTCTCTCTCTGGT | 1796 |
| TGTGCCCAGAGATGTCAAGA | 1797 |
| TCACCTCTGAACACACTGGC | 1798 |
| AGCCATTTCCATCAAGCTTT | 1799 |
| GCAGTGGACAACAGTGGAGG | 1800 |
| GGCAGTGGACAACAGTGGAG | 1801 |
| CTCAACTTCTGTTGGGTTGT | 1802 |
| GATCATGCCACCTTGGATTT | 1803 |
| CTGTGTTTGTCCTAGTATGG | 1804 |
| GAGTTGGGATTTGCAGTCAG | 1805 |
| AGAGTTGGGATTTGCAGTCA | 1806 |
| TCTGATTCCCTCAGAGAGAC | 1807 |
| GGGTTCTGTCAGATCACATG | 1808 |
| TGGGTTCTGTCAGATCACAT | 1809 |
| GGAAAGGCCACTTCTGAGTC | 1810 |
| ATCTGCCTGGACCAGAAGAC | 1811 |
| TGATCTGAGCTGTGTTTGTC | 1812 |
| CTGACTGCTATCAGCAGGAG | 1813 |
| CAAACTCTCTCTCTGGTCTC | 1814 |
| CCTCCCAACCAGAAATGGCA | 1815 |
| CAGGGCAGTGGACAACAGTG | 1816 |
| AGCTATTTGGGACAGGAGTC | 1817 |

-continued

| | |
|---|---|
| TCACTTATAACCCCACAGGC | 1818 |
| ATGCTCATAATGGAGCCCTT | 1819 |
| CTGATTGGGTAATGCAGGGC | 1820 |
| TATGCCCCAGTCTGGAAACA | 1821 |
| AACTTCTGTTGGGTTGTTGC | 1822 |
| TGCAGTCAGCAGAGCACAAT | 1823 |
| GTTGGGTTGTTGCACATTTT | 1824 |
| GGCAGAGGTCAACCAGAAGG | 1825 |
| GGGCAGAGGTCAACCAGAAG | 1826 |
| GGCTGGACTTTTGACCTTTA | 1827 |
| CCCAGTAAATCCTGTGTCAC | 1828 |
| TGAGTGTGGCTGGACTTTTG | 1829 |
| AGACAGAGGGCAAGAGGAGC | 1830 |
| CTTAGAGGAGGCTTGTGACT | 1831 |
| TTCTTTTATGTGCTGGGTTC | 1832 |
| GTCATCAGCCATTCCTTAAC | 1833 |
| CACCAAGCAACTGGAGGTCT | 1834 |
| GAGCTATTTGGGACAGGAGT | 1835 |
| GTGGACAACAGTGGAGGGTA | 1836 |
| CATAATGGAGCCCTTTCTCT | 1837 |
| CTCATAATGGAGCCCTTTCT | 1838 |
| GACAACAGAAGCTGCTGGGC | 1839 |
| CCCACAGCAGGACAAGCAAC | 1840 |
| CTGATTCCCTCAGAGAGACA | 1841 |
| CTTTCTGCTATCCATCACTT | 1842 |
| CAACAGAAGCTGCTGGGCTG | 1843 |
| AAGCTTTGTCAGCTAGTTGT | 1844 |
| CAAGCAACTGGAGGTCTGCA | 1845 |
| TCAGGCTAACATTGCTGCTT | 1846 |
| AACCTCTCTGAATACTGCCC | 1847 |
| CCAGAATCCATGTGTCTTCA | 1848 |
| GATTCCCTCAGAGAGACAGA | 1849 |
| AGTCATCAGCCATTCCTTAA | 1850 |
| ACCCATGCTCATAATGGAGC | 1851 |
| CCCTGGAGATACTCAGACAC | 1852 |
| AGCTAGGTGGAGGAAGGATC | 1853 |
| TTCCATCTGTCCTGGAATGA | 1854 |
| TGGGTTGTTGCACATTTTGT | 1855 |
| TGTTGGGTTGTTGCACATTT | 1856 |
| TGATCTGCCTGGACCAGAAG | 1857 |

-continued

| | |
|---|---|
| TGACTGCTATCAGCAGGAGA | 1858 |
| CCACAATGGGCAGAGGATCA | 1859 |
| TCATAATGGAGCCCTTTCTC | 1860 |
| CTAGATCAGCAATGCCCCAA | 1861 |
| CCCAACCAGAAATGGCAGCT | 1862 |
| GGAGTGGGACTGATTGGAGA | 1863 |
| TCCATCTGTCCTGGAATGAG | 1864 |
| AGAGAGGTGACACTTCAGGG | 1865 |
| AGCAACTCTTGTCTAAGGGC | 1866 |
| AGGCTAACATTGCTGCTTGG | 1867 |
| TGTGTCTTCATTCATTCACC | 1868 |
| GTCACCTCTGAACACACTGG | 1869 |
| TTCTCTGAGATACTTCCCAC | 1870 |
| ATCATGCCACCTTGGATTTT | 1871 |
| CTGGATGCTGGACTCTGATT | 1872 |
| GAGCTAGGTGGAGGAAGGAT | 1873 |
| TCATTCCTGGAATCCTTACC | 1874 |
| TTATGCCCCAGTCTGGAAAC | 1875 |
| ATCAGGCTAACATTGCTGCT | 1876 |
| GTAAACTGTGGGTTCTCCTG | 1877 |
| TGTAAACTGTGGGTTCTCCT | 1878 |
| ATTTGGGACAGGAGTCAGTT | 1879 |
| GGAGCTATTTGGGACAGGAG | 1880 |
| AGGAGCTATTTGGGACAGGA | 1881 |
| GAGGAGCTATTTGGGACAGG | 1882 |
| ATCTTCAACTCACTCTACCC | 1883 |
| AAGGGAAGGCCAGGAAGCTT | 1884 |
| CTATGGCAGCAGAACTGTGT | 1885 |
| GGCATCTTCAACTCACTCTA | 1886 |
| CTTCAACTCACTCTACCCAG | 1887 |
| CAAGCTGACTGCTATCAGCA | 1888 |
| CTGGCTGAAGAGTGCCAATC | 1889 |
| AGGGTTCCCCACATGAAATC | 1890 |
| ACACAGGGCAGTGGACAACA | 1891 |
| CACACAGGGCAGTGGACAAC | 1892 |
| TTTATGCCCCAGTCTGGAAA | 1893 |
| TCCCAACCAGAAATGGCAGC | 1894 |
| ATAATGGAGCCCTTTCTCTT | 1895 |
| TTATTTTCCAGAGCCATGTC | 1896 |

-continued

| | |
|---|---|
| GGGTTGTTGCACATTTTGTA | 1897 |
| TTTTCCATCTGTCCTGGAAT | 1898 |
| GGATATTCCTGCTCTGTATG | 1899 |
| TGCTATCAGCAGGAGAAGGG | 1900 |
| GAGGGTTCCCCACATGAAAT | 1901 |
| AGGAAAGGCCACTTCTGAGT | 1902 |
| GGCTGTTCTGATTGGGTAAT | 1903 |
| TGGATGCTGGACTCTGATTC | 1904 |
| GATTCTCTGAGATACTTCCC | 1905 |
| TGAGGGTTCCCCACATGAAA | 1906 |
| CTGTCCTGGAATGAGGATCT | 1907 |
| TGCCCAGAGATGTCAAGAGA | 1908 |
| CACAGGGCAGTGGACAACAG | 1909 |
| ATTCTCTGAGATACTTCCCA | 1910 |
| GAATGTGGTACCTGGTTAGT | 1911 |
| AATCATCCCCTGGAGATACT | 1912 |
| GATCAGGCTAACATTGCTGC | 1913 |
| ACCAAGCAACTGGAGGTCTG | 1914 |
| AATTGCCCACAATGGGCAGA | 1915 |
| CAGTGGACAACAGTGGAGGG | 1916 |
| TAAACTGTGGGTTCTCCTGG | 1917 |
| ATGAGATGCCTCTCTTCATG | 1918 |
| TCAACTTCTGTTGGGTTGTT | 1919 |
| TTTCCATCTGTCCTGGAATG | 1920 |
| ATCTCAACTTCTGTTGGGTT | 1921 |
| ACACCAAGCAACTGGAGGTC | 1922 |
| TAATGGAGCCCTTTCTCTTA | 1923 |
| TCTCAACTTCTGTTGGGTTG | 1924 |
| GGCTGAAGAGTGCCAATCAT | 1925 |
| GCTGACTTTTTCCTGTATGA | 1926 |
| GCTGGAAAGGCTGATCCTC | 1927 |
| TTGGAGGAAAGGCCACTTCT | 1928 |
| TCCATCACTTATAACCCCAC | 1929 |
| TCTGTCCTGGAATGAGGATC | 1930 |
| AACTCTTGTCTAAGGGCAGT | 1931 |
| GAATGAGTGTGGCTGGACTT | 1932 |
| GAGGAAGAGTGTTGCCTTTG | 1933 |
| ATCCATGTGTCTTCATTCAT | 1934 |
| CAGTCACCTCTGAACACACT | 1935 |
| CCACTTCCTCATACATTCTA | 1936 |

-continued

| | |
|---|---|
| CTGCTATCAGCAGGAGAAGG | 1937 |
| GATCTCTGGAGGAAGAGTGT | 1938 |
| GTGATCTCTGGAGGAAGAGT | 1939 |
| TATTTGGGACAGGAGTCAGT | 1940 |
| GTCCTGGAATGAGGATCTGA | 1941 |
| CCAGTAAATCCTGTGTCACT | 1942 |
| GCAGGACAAGCAACTCTTGT | 1943 |
| AAGCTGACTGCTATCAGCAG | 1944 |
| TGATTCCCTCAGAGAGACAG | 1945 |
| CCATCACTTATAACCCCACA | 1946 |
| CAATGGGCAGAGGATCATGC | 1947 |
| CATCTGTCCTGGAATGAGGA | 1948 |
| GAGAGAGGTGACACTTCAGG | 1949 |
| CTTGGTGATCTCTGGAGGAA | 1950 |
| CAGGCTAACATTGCTGCTTG | 1951 |
| GAAATGGCAGCTTCATTCCT | 1952 |
| TGGAGGAAAGGCCACTTCTG | 1953 |
| GGAAAAGGCTGATCCTCACC | 1954 |
| AGCAGGCTTTGGAGGAAAGG | 1955 |
| TGAATGAGTGTGGCTGGACT | 1956 |
| TCATCAGCCATTCCTTAACA | 1957 |
| ATCCATCACTTATAACCCCA | 1958 |
| AAAGAACAGCTTCTCCAGCC | 1959 |
| CAGAGGAGCTATTTGGGACA | 1960 |
| CCTCTGTCTAGGATCTAGAA | 1961 |
| CAATGAGATGCCTCTCTTCA | 1962 |
| GAAGCTTTGTCAGCTAGTTG | 1963 |
| GGTGATCTCTGGAGGAAGAG | 1964 |
| TTGTAAACTGTGGGTTCTCC | 1965 |
| AAGAGCCAGAAATCATCCCC | 1966 |
| TGTCTTCATTCATTCACCTA | 1967 |
| ATGGCAGCAGAACTGTGTTA | 1968 |
| TATGGCAGCAGAACTGTGTT | 1969 |
| AAAAGGCTGATCCTCACCTC | 1970 |
| GTTCTGTCAGATCACATGTA | 1971 |
| AATGAGTGTGGCTGGACTTT | 1972 |
| AGGATCAGGCTAACATTGCT | 1973 |
| TCTGATTGGGTAATGCAGGG | 1974 |
| CAGAAATCATCCCCTGGAGA | 1975 |

-continued

| | |
|---|---|
| GACTGCTATCAGCAGGAGAA | 1976 |
| GAGTGGGACTGATTGGAGAC | 1977 |
| GAAAAGGCTGATCCTCACCT | 1978 |
| CTTCATTCCTGGAATCCTTA | 1979 |
| ACAGAGGGCAAGAGGAGCAA | 1980 |
| CTTTGGAGGAAAGGCCACTT | 1981 |
| TCAAGAGAGACCAAGGCACC | 1982 |
| TGGTGATCTCTGGAGGAAGA | 1983 |
| TTGACCTTTAATGTCCCTGA | 1984 |
| GTGTTAAAGGGAAGGCCAGG | 1985 |
| ATCTCTGGAGGAAGAGTGTT | 1986 |
| ATGCCACCTTGGATTTTCAA | 1987 |
| TTTCTGCTATCCATCACTTA | 1988 |
| AGTGGGACTGATTGGAGACA | 1989 |
| AATGTGGTACCTGGTTAGTG | 1990 |
| TCCATCAAGCTTTCATCAGA | 1991 |
| TGACCTTTAATGTCCCTGAG | 1992 |
| GTTCTCCTGGTATATCTATA | 1993 |
| GAGGTAGTCAAGAGAGACCA | 1994 |
| ACAATGAGATGCCTCTCTTC | 1995 |
| CTCCCAACCAGAAATGGCAG | 1996 |
| GCATCTTCAACTCACTCTAC | 1997 |
| CTGAGAGAGGTGACACTTCA | 1998 |
| CAAGAGAGACCAAGGCACCA | 1999 |
| GGATCAGGCTAACATTGCTG | 2000 |
| AGTCACCTCTGAACACACTG | 2001 |
| ATGGAGCCCTTTCTCTTAAA | 2002 |
| AATGGAGCCCTTTCTCTTAA | 2003 |
| TGCTGGAAAAGGCTGATCCT | 2004 |
| CAACTTCTGTTGGGTTGTTG | 2005 |
| TTTGGAGGAAAGGCCACTTC | 2006 |
| ATCTGTCCTGGAATGAGGAT | 2007 |
| TTCTGCTATCCATCACTTAT | 2008 |
| GGTCAGCTTTTTGTTGCAAA | 2009 |
| AGAGGAGCTATTTGGGACAG | 2010 |
| GCCCAGAGATGTCAAGAGAA | 2011 |
| TTTTGACCTTTAATGTCCCT | 2012 |
| CTTTTGACCTTTAATGTCCC | 2013 |
| TGTCCTGGAATGAGGATCTG | 2014 |
| GTCAAGAGAGACCAAGGCAC | 2015 |

-continued

| | |
|---|---|
| TCAGCAGGAGAAGGGAATGC | 2016 |
| GCAATGCCCCAAATTGTTGA | 2017 |
| GTTCCCCACATGAAATCCAA | 2018 |
| GAGCAGGCTTTGGAGGAAAG | 2019 |
| CATCTTCAACTCACTCTACC | 2020 |
| TGGACAACAGTGGAGGGTAT | 2021 |
| AAATGGCAGCTTCATTCCTG | 2022 |
| GAGGGCAAGAGGAGCAAAGT | 2023 |
| CAGCAGGACAAGCAACTCTT | 2024 |
| TTGGGTTGTTGCACATTTTG | 2025 |
| ACTATGGCAGCAGAACTGTG | 2026 |
| AATGAGATGCCTCTCTTCAT | 2027 |
| GAAATTGCCCACAATGGGCA | 2028 |
| AAGAGAGACCAAGGCACCAC | 2029 |
| CAGCAGGAGAAGGGAATGCA | 2030 |
| CCAACCAGAAATGGCAGCTT | 2031 |
| TCTGTCAGATCACATGTACT | 2032 |
| TTTGACCTTTAATGTCCCTG | 2033 |
| CAACTCTTGTCTAAGGGCAG | 2034 |
| GATCAGCAATGCCCCAAATT | 2035 |
| CTGTGTTAAAGGGAAGGCCA | 2036 |
| CCTGAACCCATGCTCATAAT | 2037 |
| TTTCCATCAAGCTTTCATCA | 2038 |
| GCTGAAGAGTGCCAATCATT | 2039 |
| GGGCAAGAGGAGCAAAGTGA | 2040 |
| CCATCAAGCTTTCATCAGAC | 2041 |
| TATCCATCACTTATAACCCC | 2042 |
| AGATCAGCAATGCCCCAAAT | 2043 |
| AGGACAAGCAACTCTTGTCT | 2044 |
| GAATCCATGTGTCTTCATTC | 2045 |
| TTCCATCAAGCTTTCATCAG | 2046 |
| ATCACTTATAACCCCACAGG | 2047 |
| GATGGAACTATGGCAGCAGA | 2048 |
| GGACAACAGTGGAGGGTATA | 2049 |
| CTGTTCTGATTGGGTAATGC | 2050 |
| GCTGTTCTGATTGGGTAATG | 2051 |
| CCCAGTCTGGAAACATTCAT | 2052 |
| AATCCATGTGTCTTCATTCA | 2053 |
| ATTCCCTCAGAGAGACAGAA | 2054 |

-continued

| | |
|---|---|
| AGACAACAGAAGCTGCTGGG | 2055 |
| TTCATTCCTGGAATCCTTAC | 2056 |
| AATCTCAACTTCTGTTGGGT | 2057 |
| ATGAATGAGTGTGGCTGGAC | 2058 |
| GCCACCTTGGATTTTCAAAC | 2059 |
| CACAATGGGCAGAGGATCAT | 2060 |
| CAGAATCCATGTGTCTTCAT | 2061 |
| CCCTCAGAGAGACAGAAGAT | 2062 |
| GCTGATTCTCTGAGATACTT | 2063 |
| GAGCCCTTTCTCTTAAAAGT | 2064 |
| AGCAATGCCCCAAATTGTTG | 2065 |
| CTAACATTGCTGCTTGGCAA | 2066 |
| GGAGGAAGGATCAGGCTAAC | 2067 |
| ACTGTGTTAAAGGGAAGGCC | 2068 |
| GTTCTGATTGGGTAATGCAG | 2069 |
| CAGTCAGCAGAGCACAATTA | 2070 |
| AGCTGATTCTCTGAGATACT | 2071 |
| CTGGAAAAGGCTGATCCTCA | 2072 |
| TGTTAAAGGGAAGGCCAGGA | 2073 |
| AAATTGCCCACAATGGGCAG | 2074 |
| GAAATCATCCCCTGGAGATA | 2075 |
| CAGGACAAGCAACTCTTGTC | 2076 |
| AGCAGGAGAAGGGAATGCAG | 2077 |
| GGACAAGCAACTCTTGTCTA | 2078 |
| CTTAGCTGATTCTCTGAGAT | 2079 |
| GTCTTCATTCATTCACCTAA | 2080 |
| TGTTCTGATTGGGTAATGCA | 2081 |
| GGAACTATGGCAGCAGAACT | 2082 |
| TGAATGTGGTACCTGGTTAG | 2083 |
| TTTCTGTGAAATTGCCCACA | 2084 |
| TGAAATTGCCCACAATGGGC | 2085 |
| GAATCATAACCCACACAGGC | 2086 |
| AGCAGGACAAGCAACTCTTG | 2087 |
| GCTGGACTTTTGACCTTTAA | 2088 |
| TGCCACCTTGGATTTTCAAA | 2089 |
| TGAGAGAGGTGACACTTCAG | 2090 |
| GGAGCCCTTTCTCTTAAAAG | 2091 |
| AGGGCAAGAGGAGCAAAGTG | 2092 |
| CTGTCAGATCACATGTACTT | 2093 |
| TTCTGATTGGGTAATGCAGG | 2094 |

-continued

ATGAATGTGGTACCTGGTTA                                              2095

AACACCAAGCAACTGGAGGT                                              2096

ACTTCCTCATACATTCTACA                                              2097

CACTTCCTCATACATTCTAC                                              2098

ATGCTGGAAAAGGCTGATCC                                              2099

AGATGGAACTATGGCAGCAG                                              2100

TGGAGGAAGGATCAGGCTAA                                              2101

TCCTGGAATGAGGATCTGAT                                              2102

AAACAAACCTTCTGGTGCCT                                              2103

ATTTCCATCAAGCTTTCATC                                              2104

AGTAAATCCTGTGTCACTTC                                              2105

AATCCAAACTCTCTCTCTGG                                              2106

GCCCTTTCTCTTAAAAGTTT                                              2107

AGAATCCATGTGTCTTCATT                                              2108

CATCACTTATAACCCCACAG                                              2109

TGGAGCCCTTTCTCTTAAAA                                              2110

GTGGGACTGATTGGAGACAA                                              2111

TGATTCTCTGAGATACTTCC                                              2112

TGATCTCTGGAGGAAGAGTG                                              2113

GCTATCCATCACTTATAACC                                              2114

CATTTCTGTGAAATTGCCCA                                              2115

AAATCATCCCCTGGAGATAC                                              2116

CAGTAAATCCTGTGTCACTT                                              2117

AGCCCTTTCTCTTAAAAGTT                                              2118

CAGAGGGCAAGAGGAGCAAA                                              2119

TGTGTTAAAGGGAAGGCCAG                                              2120

GAACCCATGCTCATAATGGA                                              2121

TTCTGTCAGATCACATGTAC                                              2122

TAGTCAAGAGAGACCAAGGC                                              2123

ACAATGGGCAGAGGATCATG                                              2124

ACAGGATGCTGGAAAAGGCT                                              2125

CTATCCATCACTTATAACCC                                              2126

AACTATGGCAGCAGAACTGT                                              2127

GAAACAAACCTTCTGGTGCC                                              2128

CATCAGCCATTCCTTAACAA                                              2129

GTGAAATTGCCCACAATGGG                                              2130

AGTCAGCAGAGCACAATTAT                                              2131

GAGGAAGGATCAGGCTAACA                                              2132

TAGATGGAACTATGGCAGCA                                              2133

-continued

| | |
|---|---|
| CAACCAGAAATGGCAGCTTC | 2134 |
| ATTTCTGTGAAATTGCCCAC | 2135 |
| CTGACTTTTTCCTGTATGAT | 2136 |
| GGTTGTTGCACATTTTGTAA | 2137 |
| AAACCTCTCTGAATACTGCC | 2138 |
| GACAACAGTGGAGGGTATAC | 2139 |
| TCAGCAGAGCACAATTATGT | 2140 |
| GTCAGCAGAGCACAATTATG | 2141 |
| TTTGTAAACTGTGGGTTCTC | 2142 |
| CTATCAGCAGGAGAAGGGAA | 2143 |
| GTCAGATCACATGTACTTTT | 2144 |
| CACAGGATGCTGGAAAAGGC | 2145 |
| CCAGTCTGGAAACATTCATC | 2146 |
| CTCTGTCTAGGATCTAGAAT | 2147 |
| GTGAACACCAAGCAACTGGA | 2148 |
| ACTTTTGACCTTTAATGTCC | 2149 |
| AACCCATGCTCATAATGGAG | 2150 |
| GTAGTCAAGAGAGACCAAGG | 2151 |
| GGTAGTCAAGAGAGACCAAG | 2152 |
| AGGTAGTCAAGAGAGACCAA | 2153 |
| GAACACCAAGCAACTGGAGG | 2154 |
| CCTCAGAGAGACAGAAGATC | 2155 |
| TGGAACTATGGCAGCAGAAC | 2156 |
| TGAACCCATGCTCATAATGG | 2157 |
| AAGGATCAGGCTAACATTGC | 2158 |
| GCAGGAAACCTCTCTGAATA | 2159 |
| ATCAGCCATTCCTTAACAAT | 2160 |
| GATGATGACAGAGACTCTGG | 2161 |
| GGAAGGATCAGGCTAACATT | 2162 |
| TCAGCCATTCCTTAACAATG | 2163 |
| ATGCCCCAAATTGTTGAATC | 2164 |
| TCTGTCTAGGATCTAGAATC | 2165 |
| CAGCCATTCCTTAACAATGA | 2166 |
| TTCTGTGAAATTGCCCACAA | 2167 |
| ATTCTACAATGAGATGCCTC | 2168 |
| ATAGATGGAACTATGGCAGC | 2169 |
| AGGAAGGATCAGGCTAACAT | 2170 |
| GAGGAGCAAAGTGAACACCA | 2171 |
| AAGCAACTCTTGTCTAAGGG | 2172 |
| TAGCTGATTCTCTGAGATAC | 2173 |

-continued

| | |
|---|---|
| CTGTCTAGGATCTAGAATCA | 2174 |
| TTTTGTAAACTGTGGGTTCT | 2175 |
| CATTCTACAATGAGATGCCT | 2176 |
| CTGATTCTCTGAGATACTTC | 2177 |
| GGAAACTTAGCTGATTCTCT | 2178 |
| ATGGAACTATGGCAGCAGAA | 2179 |
| CCCCACATGAAATCCAAACT | 2180 |
| GAACTATGGCAGCAGAACTG | 2181 |
| CTGAACCCATGCTCATAATG | 2182 |
| TCTGTGAAATTGCCCACAAT | 2183 |
| TTAGCTGATTCTCTGAGATA | 2184 |
| GATGCTGGAAAAGGCTGATC | 2185 |
| AGTGAACACCAAGCAACTGG | 2186 |
| ATCAGCAGGAGAAGGGAATG | 2187 |
| AACTTAGCTGATTCTCTGAG | 2188 |
| TCCCCACATGAAATCCAAAC | 2189 |
| GCCACTCTGAACTTTATGAA | 2190 |
| GGACTTTTGACCTTTAATGT | 2191 |
| AAAGAGCCAGAAATCATCCC | 2192 |
| CCTTTCTCTTAAAAGTTTCC | 2193 |
| CCCTTTCTCTTAAAAGTTTC | 2194 |
| TTCCCCACATGAAATCCAAA | 2195 |
| TAATCTCAACTTCTGTTGGG | 2196 |
| ATTGGAGACAAAGAGCCAGA | 2197 |
| TATCAGCAGGAGAAGGGAAT | 2198 |
| GTCAGCTTTTTGTTGCAAAA | 2199 |
| ACAATGAATGTGGTACCTGG | 2200 |
| AGAGGAGCAAAGTGAACACC | 2201 |
| TCACATTTGGATGGACAAGT | 2202 |
| TGATCACATTTGGATGGACA | 2203 |
| GGATCTGATGATGACAGAGA | 2204 |
| GAGGATCTGATGATGACAGA | 2205 |
| CAGTCTGGAAACATTCATCT | 2206 |
| GGATCTAGAATCATAACCCA | 2207 |
| GAAATCCAAACTCTCTCTCT | 2208 |
| GAAACCTCTCTGAATACTGC | 2209 |
| CTGAAGAGTGCCAATCATTA | 2210 |
| CAAGCAACTCTTGTCTAAGG | 2211 |
| AAAAGCCATTTCCATCAAGC | 2212 |

-continued

| GACTTTTTCCTGTATGATAT | 2213 |
| TTCTCCTGGTATATCTATAA | 2214 |
| AGCTTTTTGTTGCAAAATCC | 2215 |
| GAAGAGTGCCAATCATTACA | 2216 |
| TGACTTTTTCCTGTATGATA | 2217 |
| GCTTTCATCAGACAATATCA | 2218 |
| ACATTCTACAATGAGATGCC | 2219 |
| TTTGGATGGACAAGTTAGGA | 2220 |
| TTCTCTTAAAAGTTTCCTCT | 2221 |
| GAGCAAAGTGAACACCAAGC | 2222 |
| AGCAAAGTGAACACCAAGCA | 2223 |
| CAATGCCCCAAATTGTTGAA | 2224 |
| TGGAGAAGTAAGTGGCCAAA | 2225 |
| ATTACAAATCAGCTTCAGCA | 2226 |
| CATTACAAATCAGCTTCAGC | 2227 |
| GTCTGGAAACATTCATCTTT | 2228 |
| GACTTTTGACCTTTAATGTC | 2229 |
| AGGAAACTTAGCTGATTCTC | 2230 |
| ACATTTTGTAAACTGTGGGT | 2231 |
| CACATTTGGATGGACAAGTT | 2232 |
| ATTTTGTAAACTGTGGGTTC | 2233 |
| AGGATCTAGAATCATAACCC | 2234 |
| CCCAGAGATGTCAAGAGAAA | 2235 |
| AGGATCTGATGATGACAGAG | 2236 |
| CATTTTGTAAACTGTGGGTT | 2237 |
| GCACATTTTGTAAACTGTGG | 2238 |
| GACAAGCAACTCTTGTCTAA | 2239 |
| ACTTTTTCCTGTATGATATT | 2240 |
| GCCAATCATTACAAATCAGC | 2241 |
| GAAGGATCAGGCTAACATTG | 2242 |
| TGAGGATCTGATGATGACAG | 2243 |
| TGATGATGACAGAGACTCTG | 2244 |
| AGGAAACCTCTCTGAATACT | 2245 |
| TTCCTCATACATTCTACAAT | 2246 |
| AGCTTTCATCAGACAATATC | 2247 |
| ATGAGGATCTGATGATGACA | 2248 |
| TGAAGAGTGCCAATCATTAC | 2249 |
| CTTTCTCTTAAAAGTTTCCT | 2250 |
| GGAAACCTCTCTGAATACTG | 2251 |
| TCTTCATTCATTCACCTAAA | 2252 |

-continued

AAACTTAGCTGATTCTCTGA                                          2253

GAAACTTAGCTGATTCTCTG                                          2254

GATCACATTTGGATGGACAA                                          2255

AATGCCCCAAATTGTTGAAT                                          2256

ATTTGGATGGACAAGTTAGG                                          2257

TCCTCATACATTCTACAATG                                          2258

AGCCATTCCTTAACAATGAA                                          2259

CCTCATACATTCTACAATGA                                          2260

AACTGTGTTAAAGGGAAGGC                                          2261

GATCTAGAATCATAACCCAC                                          2262

AGGAGCAAAGTGAACACCAA                                          2263

GATCTGATGATGACAGAGAC                                          2264

GCCATTCCTTAACAATGAAT                                          2265

CAAAGAGCCAGAAATCATCC                                          2266

CAGGAAACCTCTCTGAATAC                                          2267

TTAATCTCAACTTCTGTTGG                                          2268

TTTCTCTTAAAAGTTTCCTC                                          2269

ACAAGCAACTCTTGTCTAAG                                          2270

ATAAAGAACAGCTTCTCCAG                                          2271

GGGAAAGGATGAATGAGTGT                                          2272

CTATAAAGAACAGCTTCTCC                                          2273

ACTGAAACAAACCTTCTGGT                                          2274

CTTTTTCCTGTATGATATTA                                          2275

CTTCATTCATTCACCTAAAC                                          2276

GGAGAAGTAAGTGGCCAAAA                                          2277

GTTGTTGCACATTTTGTAAA                                          2278

GTGCCAATCATTACAAATCA                                          2279

GCAAAGTGAACACCAAGCAA                                          2280

CACATTTTGTAAACTGTGGG                                          2281

ACTGATTGGAGACAAAGAGC                                          2282

TGGACTTTTGACCTTTAATG                                          2283

TCTCCTGGTATATCTATAAA                                          2284

TTACAAATCAGCTTCAGCAA                                          2285

GTTAGGAAACTTAGCTGATT                                          2286

ACATTTGGATGGACAAGTTA                                          2287

TTGGATGGACAAGTTAGGAA                                          2288

TAGGAAACTTAGCTGATTCT                                          2289

CAGCTTTTTGTTGCAAAATC                                          2290

TCAGCTTTTTGTTGCAAAAT                                          2291

-continued

| | |
|---|---|
| AGTTAGGAAACTTAGCTGAT | 2292 |
| CCACATGAAATCCAAACTCT | 2293 |
| CTGAAACAAACCTTCTGGTG | 2294 |
| TATAAAGAACAGCTTCTCCA | 2295 |
| TCCTTAACAATGAATGTGGT | 2296 |
| CATTTGGATGGACAAGTTAG | 2297 |
| GAGATGATTCCAAAGAGGAT | 2298 |
| CCAATCATTACAAATCAGCT | 2299 |
| TTATAGATGGAACTATGGCA | 2300 |
| TTGCACATTTTGTAAACTGT | 2301 |
| GTTGCACATTTTGTAAACTG | 2302 |
| TGTTGCACATTTTGTAAACT | 2303 |
| AGAGTGCCAATCATTACAAA | 2304 |
| AAGAGTGCCAATCATTACAA | 2305 |
| AAGTGAACACCAAGCAACTG | 2306 |
| CAAGCTTTCATCAGACAATA | 2307 |
| TCATTACAAATCAGCTTCAG | 2308 |
| TATAGATGGAACTATGGCAG | 2309 |
| GAGTGCCAATCATTACAAAT | 2310 |
| AGTGCCAATCATTACAAATC | 2311 |
| CATCAGACAATATCACATGT | 2312 |
| ATCATTACAAATCAGCTTCA | 2313 |
| TGCACATTTTGTAAACTGTG | 2314 |
| ACATGTACTTTTAATGTGGA | 2315 |
| CACATGTACTTTTAATGTGG | 2316 |
| GAATGAGGATCTGATGATGA | 2317 |
| CTTTCATCAGACAATATCAC | 2318 |
| AACAATGAATGTGGTACCTG | 2319 |
| ACAAGTTAGGAAACTTAGCT | 2320 |
| CCAGAGATGTCAAGAGAAAC | 2321 |
| TTTATAGATGGAACTATGGC | 2322 |
| CAGACAATATCACATGTACT | 2323 |
| ATTTAATCTCAACTTCTGTT | 2324 |
| TTTAATCTCAACTTCTGTTG | 2325 |
| GGATGGACAAGTTAGGAAAC | 2326 |
| GAGAAGTAAGTGGCCAAAAC | 2327 |
| TTAGGAAACTTAGCTGATTC | 2328 |
| AGAAGTAAGTGGCCAAAACA | 2329 |
| TCCTGGTATATCTATAAAGA | 2330 |
| GAACTGTGTTAAAGGGAAGG | 2331 |

-continued

| | |
|---|---|
| TCCAAAGAGGATAAACCAGA | 2332 |
| TTTCATCAGACAATATCACA | 2333 |
| TAACAATGAATGTGGTACCT | 2334 |
| CAAGAGGAGCAAAGTGAACA | 2335 |
| AATGAGGATCTGATGATGAC | 2336 |
| TACATTCTACAATGAGATGC | 2337 |
| AAGCTTTCATCAGACAATAT | 2338 |
| AAGTTAGGAAACTTAGCTGA | 2339 |
| CAAGTTAGGAAACTTAGCTG | 2340 |
| CCTTAACAATGAATGTGGTA | 2341 |
| GACAAGTTAGGAAACTTAGC | 2342 |
| TGGATGGACAAGTTAGGAAA | 2343 |
| GGAAAGGATGAATGAGTGTG | 2344 |
| TTCATCAGACAATATCACAT | 2345 |
| AGATGATTCCAAAGAGGATA | 2346 |
| TTGTTGCACATTTTGTAAAC | 2347 |
| TCTATAAAGAACAGCTTCTC | 2348 |
| TCAGACAATATCACATGTAC | 2349 |
| ATCACATGTACTTTTAATGT | 2350 |
| AAAGTGAACACCAAGCAACT | 2351 |
| ACAAAGAGCCAGAAATCATC | 2352 |
| TGCCAATCATTACAAATCAG | 2353 |
| TCATCAGACAATATCACATG | 2354 |
| TAGGATCTAGAATCATAACC | 2355 |
| AAGAGGAGCAAAGTGAACAC | 2356 |
| TTCCAAAGAGGATAAACCAG | 2357 |
| ATCAGACAATATCACATGTA | 2358 |
| CTCATACATTCTACAATGAG | 2359 |
| TTCCTTAACAATGAATGTGG | 2360 |
| ATGTCAAGAGAAACAGGAGA | 2361 |
| GATGTCAAGAGAAACAGGAG | 2362 |
| AGATGTCAAGAGAAACAGGA | 2363 |
| GAGATGTCAAGAGAAACAGG | 2364 |
| ATTCCAAAGAGGATAAACCA | 2365 |
| GATTCCAAAGAGGATAAACC | 2366 |
| CAAAGTGAACACCAAGCAAC | 2367 |
| CCATTCCTTAACAATGAATG | 2368 |
| ATGGACAAGTTAGGAAACTT | 2369 |
| TTAACAATGAATGTGGTACC | 2370 |

-continued

| | |
|---|---|
| TCATACATTCTACAATGAGA | 2371 |
| ATCTATAAAGAACAGCTTCT | 2372 |
| GAAGTAAGTGGCCAAAACAA | 2373 |
| GCCAAAACAAACACATTTCT | 2374 |
| GGACAAGTTAGGAAACTTAG | 2375 |
| TGGACAAGTTAGGAAACTTA | 2376 |
| AATTTAATCTCAACTTCTGT | 2377 |
| CATTCCTTAACAATGAATGT | 2378 |
| GATCACATGTACTTTTAATG | 2379 |
| CAATCATTACAAATCAGCTT | 2380 |
| CAGAGATGTCAAGAGAAACA | 2381 |
| AATCATTACAAATCAGCTTC | 2382 |
| GATGATTCCAAAGAGGATAA | 2383 |
| CCAAAGAGGATAAACCAGAA | 2384 |
| CTAGGATCTAGAATCATAAC | 2385 |
| CATACATTCTACAATGAGAT | 2386 |
| CCTGGTATATCTATAAAGAA | 2387 |
| AGAGATGTCAAGAGAAACAG | 2388 |
| ATTCCTTAACAATGAATGTG | 2389 |
| TTTTATAGATGGAACTATGG | 2390 |
| TCCTGTATGATATTAAGAAT | 2391 |
| CTTAACAATGAATGTGGTAC | 2392 |
| TCAGCAAACTGAAACAAACC | 2393 |
| AGCAAACTGAAACAAACCTT | 2394 |
| TATCTATAAAGAACAGCTTC | 2395 |
| ATACATTCTACAATGAGATG | 2396 |
| AAGTAAGTGGCCAAAACAAA | 2397 |
| CATTTTATAGATGGAACTAT | 2398 |
| CAAACACATTTCTGTGAAAT | 2399 |
| GTATATCTATAAAGAACAGC | 2400 |
| CTTCAGCAAACTGAAACAAA | 2401 |
| ATTTTATAGATGGAACTATG | 2402 |
| TATATCTATAAAGAACAGCT | 2403 |
| CTGGTATATCTATAAAGAAC | 2404 |
| GGTATATCTATAAAGAACAG | 2405 |
| TGGTATATCTATAAAGAACA | 2406 |
| TTCAGCAAACTGAAACAAAC | 2407 |
| CTGTATGATATTAAGAATTA | 2408 |
| GATATTAAGAATTATATTTC | 2409 |
| GCACAGCCTGCATGTCCTCA | 2410 |

-continued

```
GCCCAGGCCCTTGCTCAGAA                                          2411

AGGTTGTCTCAGCCCAGGGA                                          2412
```

EQUIVALENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA)

or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to, such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified or naturally occurring bases, such as "AT$^{me}$CGAUCG," wherein $^{me}$C indicates a cytosine base comprising a methyl group at the 5-position.

SEQUENCE LISTING (2412 sequences)

SEQ ID NO: 1 - protein, 724 aa, Homo sapiens
MVLTLLLSAYKLCRFFAMSGPRPGAERLAVPGPDGGGGTGPWWAAGGRGPREVSPGAGTEVQDALERALPELQQALSALKQAGGARAVGAGLAEVFQLVEEAWLLPAVGREVAQGLCDAIRLDGGLDLLLRLLQAPELETRVQAARLLEQILVAENRDRVARIGLGVILNLAKEREPVELARSVAGILEHMFKHSEETCQRLVAAGGLDAVLYWCRRTDPALLRHCALALGNCALHGGQAVQRRMVEKRAAEWLFPLAFSKEDELLRLHACLAVAVLATNKEVEREVERSGTLALVEPLVASLDPGRFARCLVDASDTSQGRGPDDLQRLVPLLDSNRLEAQCIGAFYLCAEAAIKSLQGKTKVFSDIGAIQSLKRLVSYSTNGTKSALAKRALRLLGEEVPRPILPSVPSWKEAEVQTWLQQIGFSKYCESFREQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAAREMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 2 - DNA, 10277 bp, Homo sapiens
atctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggccgcgggccccgcgaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgccggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgccagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgacggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcgttttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataacttttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggagagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaagtacatgtgatattgtctgatgaaagcttgatggaaatggcttttttctggtttatcctctttggaatcatctcctgtttgggattaactgctggtctgatcagttccaatattcatagcggtgtcaccactgaatagcttcttatcctttgggttcctgttcctccttctgctaaataaggataatacctatttcctagattgtgagcaacattaagttcacatggaaatcacccatcactgggcctggtcccctggaagtagctagttagtaagggctgttcttttctcctgtttctcttgacatctctgggcacagagaaagtgctgggaaaaaaagtttaggtgaatgaatgaagacacatggattctggggacaccagaacccacagtgggctctgtatggcaccagagtctctgtcatcatcagatcctcattccaggacagatggaaaaagatgaatgtttccagactggggcataaagacccagaggctggagaagctgttctttatagatataccaggagaacccacagtttacaaaatgtgcaacaacccaacagaagttgagattaaattctgtcacatctagaggggtctgtgatgtcatcaaaagcaaaccacccacatcacagatgaagaaacaggcctgtggcagggctcggactaaaacccagatcctgagaccagctgcttttaaacacagacgtaggtttgcatcctagctccaccatttactgagtaaccttgggtgagccaatgtaaccccctgggtctctgtttctttatctgtcaactgtggaaaatgaaacccatgtcacaaggttgttcacttctgggcttgtacacgctgaccccagagaaacagggaactctggcatcaccacacccatcttacagacggaaaagctgaggtctgcagagagtaaatcctctgctctggttatctagaaagaacataattgtgctctgctgactgcaaatcccaactctgcggtttgaaaatccaaggtggcatgatcctctgcccattgtgggcaatttcacagaaatgtgtttgttttggccacttacttctccagggtgagaggggggaaggcaagctgttcccccagccatggctgcccatcagcccgtttcgggcagcactggacatgaggaaccagacacaggtgggttctgacactcaccctgctctgtctctctcaccagcttggagagtttagcccggatgacaggtgtgatgactaatgacaggaaaagcaacccatatcctgtggagaaacaaacactcatcaggaaaatggggctggggagaggggcgtccaagggaaaggcagcagagctcctatccataccccacgtggggcttaggttagacccaggaagaacttccttgatggtgagggtgggaagacagtagtcaaggaggaatggagactgcccttgtctgggcttggccacctgctagctctcatgaatgaatgctaattcccattgattgctttcttgtctgaacctcttgtggtcacagcaggcatcacccacccacttggcacttagtagggatatggcagggcacagaaaacaagcatgggctttggagtcagccctgagttcaaaacctgatgccattacatattatctgtgtggcctggggtacttaccctctctgatcctgactccctgtatgaggaagataataaggccttcatcacaggatggttctgaggcataggaggctgaataatggtgcccaatggcatcagattcatagccctggaacctgtaaatactaccttatttggaaaatgagtctatgcaggtgtgcagttaagcctcctgagagagcagagttatcctggattaggttgggccctaaatgccgtcacacatatctttataagaggaaagcagacggagatttggcaccgacagaattgagaaggcacaaagaggaggagagtcaatgtgagcacagaggcagagactggtgatggccgccccaagccaaggaatgccagcagccccagaagctggaagaaatgagaaacacgttctctcctggaggcttgcaagggagcactgcctgctgactgcttccattcagcccggtggtactgactttggacttctggcctccagaactgtgagagaatatgtttctgttgtgttaagcccccaagtttgtggtatgtcattacagcaatctcagggaaccaatacatgaggtaaaaaggtaacatctatgaagagcatggcatagggacacagcaaatgggagttccttttccctttgcattcagttacttacaggcttcctgttttcttcataaccatttctctccctgtgcgactgctgactcctcagcaaaactgcaaactcctacaggacagtggatcctccaaagaaggtatacgatgaggcatccagggaccctagcagtgtcaggcccctcaaatcccactctgttgagacctccccccgacccagagcaatgacagcatctttatcatctctgcatcccccagggccatcagcaggagggaaaggttcccttctgcttaattgtcagacaagcagttgagttaagaaatctgtgattattgtattgttgactatacacagcacattttagggctctatcaaaataaatctgtccctttaaaaaaagttaactaaagccgggcacggtggctcatgcctgtaatcccaacactttgggaggctgaggcaggcggatccttgagctcaggagttagagacctggactgggcaaaatggtgaggaccccatctctataaaaaatacaaaaattagcaaggtgtggtaatgtgcaccagtggtcccagctactagagaggccaaggtgggaggatcatctgggcccgggggatgaggctgcagtgagccatgatcgtgccactgcactctagcctgggtaacaaagcgagaccctgtctctaaatacatcaatcaaataaaaattttaaaaagttaa

SEQ ID NO: 3 - DNA, 20 bp, Artificial Sequence
  source: /note="Description of Artificial Sequence: Synthetic oligonucleotide"
ggcctcctccaccagttgga

SEQ ID NO: 4 - DNA, 20 bp, Artificial Sequence
  source: /note="Description of Artificial Sequence: Synthetic oligonucleotide"
gcaggctcttgatggcagcc

SEQ ID NO: 5 - DNA, 20 bp, Artificial Sequence
  source: /note="Description of Artificial Sequence: Synthetic oligonucleotide"
gccatccacctgctgctccc

SEQ ID NO: 6 - DNA, 20 bp, Artificial Sequence
  source: /note="Description of Artificial Sequence: Synthetic oligonucleotide"
tccccactgggtttgccacc

SEQ ID NO: 7 - DNA, 20 bp, Artificial Sequence
  source: /note="Description of Artificial Sequence: Synthetic oligonucleotide"
acttgcctgcttccagcttc

SEQ ID NO: 8 - DNA, 20 bp, Artificial Sequence
  source: /note="Description of Artificial Sequence: Synthetic oligonucleotide"
cttgtccagtgctccaggtg

SEQ ID NO: 9 - DNA, 20 bp, Artificial Sequence
  source: /note="Description of Artificial Sequence: Synthetic oligonucleotide"
gcacagcctgcatgtcctca

SEQ ID NO: 10 - DNA, 20 bp, Artificial Sequence
  source: /note="Description of Artificial Sequence: Synthetic oligonucleotide"
cccaggttgtctcagcccag

SEQ ID NO: 11 - DNA, 20 bp, Artificial Sequence
  source: /note="Description of Artificial Sequence: Synthetic oligonucleotide"
tcccttccctctccagatac

SEQ ID NO: 12 - DNA, 20 bp, Artificial Sequence
  source: /note="Description of Artificial Sequence: Synthetic oligonucleotide"
tgcagaaccacccccacccc

SEQ ID NO: 13 - DNA, 20 bp, Artificial Sequence
  source: /note="Description of Artificial Sequence: Synthetic oligonucleotide"
gcccaggcccttgctcagaa

SEQ ID NO: 14 - DNA, 20 bp, Artificial Sequence
  source: /note="Description of Artificial Sequence: Synthetic oligonucleotide"
ggcactcatccctggctggc

SEQ ID NO: 15 - DNA, 20 bp, Artificial Sequence
  source: /note="Description of Artificial Sequence: Synthetic oligonucleotide"
ccccatgcccagacccaggc

SEQ ID NO: 16 - DNA, 20 bp, Artificial Sequence
  source: /note="Description of Artificial Sequence: Synthetic oligonucleotide"
gcctctttccacagagctgc

SEQ ID NO: 17 - DNA, 20 bp, Artificial Sequence
  source: /note="Description of Artificial Sequence: Synthetic oligonucleotide"
tctcagccaccaggatctgc

SEQ ID NO: 18 - DNA, 20 bp, Artificial Sequence
  source: /note="Description of Artificial Sequence: Synthetic oligonucleotide"
gagctccctaaagaacctct

SEQ ID NO: 19 - DNA, 20 bp, Artificial Sequence
  source: /note="Description of Artificial Sequence: Synthetic oligonucleotide"
ccaggttgtctcagcccagg

SEQ ID NO: 20 - DNA, 20 bp, Artificial Sequence
  source: /note="Description of Artificial Sequence: Synthetic oligonucleotide"
ggtgcagcagggagcggtcc

SEQ ID NO: 21 - DNA, 20 bp, Artificial Sequence
  source: /note="Description of Artificial Sequence: Synthetic oligonucleotide"
gcagcgtcaggaccatgggc

SEQ ID NO: 22 - DNA, 20 bp, Artificial Sequence
  source: /note="Description of Artificial Sequence: Synthetic oligonucleotide"
accaggcgtttcaggctctg

SEQ ID NO: 23 - DNA, 20 bp, Artificial Sequence
  source: /note="Description of Artificial Sequence: Synthetic oligonucleotide"
cacctcctcgcccagcaggc

SEQ ID NO: 24 - DNA, 20 bp, Artificial Sequence
  source: /note="Description of Artificial Sequence: Synthetic oligonucleotide"
gtctggagttcctcctccgt

SEQ ID NO: 25 - DNA, 20 bp, Artificial Sequence
  source: /note="Description of Artificial Sequence: Synthetic oligonucleotide"
ccctcgccctggatgtggca

SEQ ID NO: 26 - DNA, 20 bp, Artificial Sequence
  source: /note="Description of Artificial Sequence: Synthetic oligonucleotide"
ggcctgcacacgcgtctcca

SEQ ID NO: 27 - DNA, 20 bp, Artificial Sequence
  source: /note="Description of Artificial Sequence: Synthetic oligonucleotide"
acttgtccagtgctccaggt

SEQ ID NO: 28 - DNA, 20 bp, Artificial Sequence
  source: /note="Description of Artificial Sequence: Synthetic oligonucleotide"
agcacagcctgcatgtcctc

SEQ ID NO: 29 - DNA, 20 bp, Artificial Sequence
  source: /note="Description of Artificial Sequence: Synthetic oligonucleotide"
gcccaggttgtctcagccca

SEQ ID NO: 30 - DNA, 20 bp, Artificial Sequence
  source: /note="Description of Artificial Sequence: Synthetic oligonucleotide"
gcactcatccctggctggct

SEQ ID NO: 31 - DNA, 20 bp, Artificial Sequence
  source: /note="Description of Artificial Sequence: Synthetic oligonucleotide"
atgcccagacccaggcccaa

SEQ ID NO: 32 - DNA, 20 bp, Artificial Sequence
  source: /note="Description of Artificial Sequence: Synthetic oligonucleotide"
aggctcttgatggcagcctc

SEQ ID NO: 33 - DNA, 20 bp, Artificial Sequence
  source: /note="Description of Artificial Sequence: Synthetic oligonucleotide"
ttctcagccaccaggatctg

SEQ ID NO: 34 - DNA, 20 bp, Artificial Sequence
  source: /note="Description of Artificial Sequence: Synthetic oligonucleotide"
ggttctcagccaccaggatc

SEQ ID NO: 35 - DNA, 20 bp, Artificial Sequence
  source: /note="Description of Artificial Sequence: Synthetic oligonucleotide"
gtgagctccctaaagaacct

SEQ ID NO: 36 - DNA, 20 bp, Artificial Sequence
  source: /note="Description of Artificial Sequence: Synthetic oligonucleotide"
ttgtccagtgctccaggtga

SEQ ID NO: 37 - DNA, 20 bp, Artificial Sequence
  source: /note="Description of Artificial Sequence: Synthetic oligonucleotide"
ggttgtctcagcccagggag

SEQ ID NO: 38 - DNA, 20 bp, Artificial Sequence
  source: /note="Description of Artificial Sequence: Synthetic oligonucleotide"
aggttgtctcagcccaggga

SEQ ID NO: 39 - DNA, 20 bp, Artificial Sequence
  source: /note="Description of Artificial Sequence: Synthetic oligonucleotide"
caggttgtctcagcccaggg

SEQ ID NO: 40 - DNA, 20 bp, Artificial Sequence
  source: /note="Description of Artificial Sequence: Synthetic oligonucleotide"
cactcatccctggctggctc

SEQ ID NO: 41 - DNA, 20 bp, Artificial Sequence
  source: /note="Description of Artificial Sequence: Synthetic oligonucleotide"
tggcactcatccctggctgg

SEQ ID NO: 42 - DNA, 20 bp, Artificial Sequence
  source: /note="Description of Artificial Sequence: Synthetic oligonucleotide"
agctccctaaagaacctctt

SEQ ID NO: 43 - DNA, 20 bp, Artificial Sequence
  source: /note="Description of Artificial Sequence: Synthetic oligonucleotide"
ctccctaaagaacctcttgc

SEQ ID NO: 44 - DNA, 20 bp, Artificial Sequence
  source: /note="Description of Artificial Sequence: Synthetic oligonucleotide"
gctccctaaagaacctcttg

SEQ ID NO: 45 - DNA, 20 bp, Artificial Sequence
  source: /note="Description of Artificial Sequence: Synthetic oligonucleotide"
tgagctccctaaagaacctc

SEQ ID NO: 46 - DNA, 20 bp, Artificial Sequence
  source: /note="Description of Artificial Sequence: Synthetic oligonucleotide"
gtgcagcagggagcggtcca

SEQ ID NO: 47 - DNA, 20 bp, Artificial Sequence
  source: /note="Description of Artificial Sequence: Synthetic oligonucleotide"
ccaggcgtttcaggctctgg

SEQ ID NO: 48 - DNA, 20 bp, Artificial Sequence
  source: /note="Description of Artificial Sequence: Synthetic oligonucleotide"
caggcgtttcaggctctgga

SEQ ID NO: 49 - DNA, 20 bp, Artificial Sequence
  source: /note="Description of Artificial Sequence: Synthetic oligonucleotide"
cggttctcagccaccaggat

SEQ ID NO: 50 - DNA, 20 bp, Artificial Sequence
  source: /note="Description of Artificial Sequence: Synthetic oligonucleotide"
aggcgtttcaggctctggat

SEQ ID NO: 51 - DNA, 20 bp, Artificial Sequence
  source: /note="Description of Artificial Sequence: Synthetic oligonucleotide"
aaccaggcgtttcaggctct

SEQ ID NO: 52 - DNA, 20 bp, Artificial Sequence
  source: /note="Description of Artificial Sequence: Synthetic oligonucleotide"
ccatccacctgctgctcccg

SEQ ID NO: 53 - DNA, 20 bp, Artificial Sequence
  source: /note="Description of Artificial Sequence: Synthetic oligonucleotide"
tggcacctcctcgcccagca

SEQ ID NO: 54 - DNA, 20 bp, Artificial Sequence
  source: /note="Description of Artificial Sequence: Synthetic oligonucleotide"
ggtcgccatccacctgctgc

SEQ ID NO: 55 - DNA, 20 bp, Artificial Sequence
  source: /note="Description of Artificial Sequence: Synthetic oligonucleotide"
gtcgccatccacctgctgct

SEQ ID NO: 56 - DNA, 20 bp, Artificial Sequence
  source: /note="Description of Artificial Sequence: Synthetic oligonucleotide"
cgccatccacctgctgctcc

SEQ ID NO: 57 - DNA, 20 bp, Artificial Sequence
  source: /note="Description of Artificial Sequence: Synthetic oligonucleotide"
atccacctgctgctcccgga

SEQ ID NO: 58 - DNA, 20 bp, Artificial Sequence
  source: /note="Description of Artificial Sequence: Synthetic oligonucleotide"
tcgccatccacctgctgctc

SEQ ID NO: 59 - DNA, 20 bp, Artificial Sequence
  source: /note="Description of Artificial Sequence: Synthetic oligonucleotide"
catccacctgctgctcccgg

SEQ ID NO: 60 - DNA, 20 bp, Artificial Sequence
  source: /note="Description of Artificial Sequence: Synthetic oligonucleotide"
gtggcacctcctcgcccagc

SEQ ID NO: 61 - DNA, 20 bp, Artificial Sequence
  source: /note="Description of Artificial Sequence: Synthetic oligonucleotide"
ggtcggtctggagttcctcc

SEQ ID NO: 62 - DNA, 20 bp, Artificial Sequence
  source: /note="Description of Artificial Sequence: Synthetic oligonucleotide"
gtcggtctggagttcctcct

SEQ ID NO: 63 - DNA, 20 bp, Artificial Sequence
  source: /note="Description of Artificial Sequence: Synthetic oligonucleotide"
accctcgccctggatgtggc

SEQ ID NO: 64 - DNA, 20 bp, Artificial Sequence
  source: /note="Description of Artificial Sequence: Synthetic oligonucleotide"
gagttcctcctccgtgagcc

SEQ ID NO: 65 - DNA, 20 bp, Artificial Sequence
  source: /note="Description of Artificial Sequence: Synthetic oligonucleotide"
ggtctggagttcctcctccg

SEQ ID NO: 66 - DNA, 20 bp, Artificial Sequence
  source: /note="Description of Artificial Sequence: Synthetic oligonucleotide"
cggtctggagttcctcctcc

SEQ ID NO: 67 - DNA, 20 bp, Artificial Sequence
  source: /note="Description of Artificial Sequence: Synthetic oligonucleotide"
ggagttcctcctccgtgagc

SEQ ID NO: 68 - DNA, 20 bp, Artificial Sequence
  source: /note="Description of Artificial Sequence: Synthetic oligonucleotide"
tgcagcagggagcggtccag

SEQ ID NO: 69 - DNA, 20 bp, Artificial Sequence
  source: /note="Description of Artificial Sequence: Synthetic oligonucleotide"
agcagcgtcaggaccatggg

SEQ ID NO: 70 - DNA, 20 bp, Artificial Sequence
  source: /note="Description of Artificial Sequence: Synthetic oligonucleotide"
gaacctcttgcgggtgatgc

SEQ ID NO: 71 - DNA, 20 bp, Artificial Sequence
  source: /note="Description of Artificial Sequence: Synthetic oligonucleotide"
aaaccaggcgtttcaggctc

SEQ ID NO: 72 - DNA, 20 bp, Artificial Sequence
  source: /note="Description of Artificial Sequence: Synthetic oligonucleotide"
gaaaccaggcgtttcaggct

SEQ ID NO: 73 - DNA, 20 bp, Artificial Sequence
  source: /note="Description of Artificial Sequence: Synthetic oligonucleotide"
agaacctcttgcgggtgatg

SEQ ID NO: 74 - DNA, 20 bp, Artificial Sequence
  source: /note="Description of Artificial Sequence: Synthetic oligonucleotide"
aagaacctcttgcgggtgat

SEQ ID NO: 75 - DNA, 20 bp, Artificial Sequence
  source: /note="Description of Artificial Sequence: Synthetic oligonucleotide"
ccctaaagaacctcttgcgg

SEQ ID NO: 76 - DNA, 20 bp, Artificial Sequence
  source: /note="Description of Artificial Sequence: Synthetic oligonucleotide"
tccctaaagaacctcttgcg

SEQ ID NO: 77 - DNA, 20 bp, Artificial Sequence
  source: /note="Description of Artificial Sequence: Synthetic oligonucleotide"
cctaaagaacctcttgcggg

SEQ ID NO: 78 - DNA, 20 bp, Artificial Sequence
  source: /note="Description of Artificial Sequence: Synthetic oligonucleotide"
ctaaagaacctcttgcgggt

SEQ ID NO: 79 - DNA, 20 bp, Artificial Sequence
  source: /note="Description of Artificial Sequence: Synthetic oligonucleotide"
taaagaacctcttgcgggtg

SEQ ID NO: 80 - DNA, 20 bp, Artificial Sequence
  source: /note="Description of Artificial Sequence: Synthetic oligonucleotide"
gcccacggccggcagcagcc

SEQ ID NO: 81 - DNA, 20 bp, Artificial Sequence
  source: /note="Description of Artificial Sequence: Synthetic oligonucleotide"
gcggtgcagcagggagcggt

SEQ ID NO: 82 - DNA, 20 bp, Artificial Sequence
  source: /note="Description of Artificial Sequence: Synthetic oligonucleotide"
ccacggccggcagcagccag

SEQ ID NO: 83 - DNA, 20 bp, Artificial Sequence
  source: /note="Description of Artificial Sequence: Synthetic oligonucleotide"
cacggccggcagcagccagg

SEQ ID NO: 84 - DNA, 20 bp, Artificial Sequence
  source: /note="Description of Artificial Sequence: Synthetic oligonucleotide"
cggtgcagcagggagcggtc

SEQ ID NO: 85 - DNA, 20 bp, Artificial Sequence
  source: /note="Description of Artificial Sequence: Synthetic oligonucleotide"
cacgcggtgcagcagggagc

SEQ ID NO: 86 - DNA, 20 bp, Artificial Sequence
  source: /note="Description of Artificial Sequence: Synthetic oligonucleotide"
agcgtcaggaccatgggcgc

SEQ ID NO: 87 - DNA, 20 bp, Artificial Sequence
  source: /note="Description of Artificial Sequence: Synthetic oligonucleotide"
gacacgcggtgcagcaggga

SEQ ID NO: 88 - DNA, 20 bp, Artificial Sequence
  source: /note="Description of Artificial Sequence: Synthetic oligonucleotide"
gccccgatgcactgcgcctc

SEQ ID NO: 89 - DNA, 20 bp, Artificial Sequence
  source: /note="Description of Artificial Sequence: Synthetic oligonucleotide"
ccccgatgcactgcgcctcc

SEQ ID NO: 90 - DNA, 20 bp, Artificial Sequence
  source: /note="Description of Artificial Sequence: Synthetic oligonucleotide"
gcccgtgccaccgcccccat

SEQ ID NO: 91 - DNA, 20 bp, Artificial Sequence
  source: /note="Description of Artificial Sequence: Synthetic oligonucleotide"
ttcctcctccgtgagccgca

SEQ ID NO: 92 - DNA, 20 bp, Artificial Sequence
  source: /note="Description of Artificial Sequence: Synthetic oligonucleotide"
tcctcctccgtgagccgcag

SEQ ID NO: 93 - DNA, 20 bp, Artificial Sequence
  source: /note="Description of Artificial Sequence: Synthetic oligonucleotide"
agccccgatgcactgcgcct

SEQ ID NO: 94 - DNA, 20 bp, Artificial Sequence
  source: /note="Description of Artificial Sequence: Synthetic oligonucleotide"
cctcctccgtgagccgcaga

SEQ ID NO: 95 - DNA, 20 bp, Artificial Sequence
  source: /note="Description of Artificial Sequence: Synthetic oligonucleotide"
cccacggccggcagcagcca

SEQ ID NO: 96 - DNA, 20 bp, Artificial Sequence
  source: /note="Description of Artificial Sequence: Synthetic oligonucleotide"
acggccggcagcagccaggc

SEQ ID NO: 97 - DNA, 20 bp, Artificial Sequence
  source: /note="Description of Artificial Sequence: Synthetic oligonucleotide"
cagcgtcaggaccatgggcg

SEQ ID NO: 98 - DNA, 20 bp, Artificial Sequence
  source: /note="Description of Artificial Sequence: Synthetic oligonucleotide"
acacgcggtgcagcagggag

SEQ ID NO: 99 - DNA, 20 bp, Artificial Sequence
  source: /note="Description of Artificial Sequence: Synthetic oligonucleotide"
taggtgtactggcggaagcg

SEQ ID NO: 100 - DNA, 20 bp, Artificial Sequence
  source: /note="Description of Artificial Sequence: Synthetic oligonucleotide"
gggtccaggctgcccagcca

SEQ ID NO: 101 - DNA, 20 bp, Artificial Sequence
  source: /note="Description of Artificial Sequence: Synthetic oligonucleotide"
gtccaggctgcccagccagt

SEQ ID NO: 102 - DNA, 20 bp, Artificial Sequence
  source: /note="Description of Artificial Sequence: Synthetic oligonucleotide"
ggtccaggctgcccagccag

SEQ ID NO: 103 - DNA, 20 bp, Artificial Sequence
  source: /note="Description of Artificial Sequence: Synthetic oligonucleotide"
gtccaggctgccctgcttgt

SEQ ID NO: 104 - DNA, 20 bp, Artificial Sequence
  source: /note="Description of Artificial Sequence: Synthetic oligonucleotide"
tccaggctgccctgcttgtc

SEQ ID NO: 105 - DNA, 20 bp, Artificial Sequence
  source: /note="Description of Artificial Sequence: Synthetic oligonucleotide"
ccatgggtgcagcaccctcc

SEQ ID NO: 106 - DNA, 20 bp, Artificial Sequence
  source: /note="Description of Artificial Sequence: Synthetic oligonucleotide"
ggtcttgccttgcaggctct

SEQ ID NO: 107 - DNA, 20 bp, Artificial Sequence
  source: /note="Description of Artificial Sequence: Synthetic oligonucleotide"
cctgtctgaggctgccttcc

SEQ ID NO: 108 - DNA, 20 bp, Artificial Sequence
  source: /note="Description of Artificial Sequence: Synthetic oligonucleotide"
aggcctcctccaccagttgg

SEQ ID NO: 109 - DNA, 20 bp, Artificial Sequence
  source: /note="Description of Artificial Sequence: Synthetic oligonucleotide"
actgagcagggaccctcccc

SEQ ID NO: 110 - DNA, 20 bp, Artificial Sequence
  source: /note="Description of Artificial Sequence: Synthetic oligonucleotide"
ccccactgggtttgccacca

SEQ ID NO: 111 - DNA, 20 bp, Artificial Sequence
  source: /note="Description of Artificial Sequence: Synthetic oligonucleotide"
cagcctgcatgtcctcaggc

SEQ ID NO: 112 - DNA, 20 bp, Artificial Sequence
  source: /note="Description of Artificial Sequence: Synthetic oligonucleotide"
tcctgtctgaggctgccttc

SEQ ID NO: 113 - DNA, 20 bp, Artificial Sequence
  source: /note="Description of Artificial Sequence: Synthetic oligonucleotide"
tggtcttgccttgcaggctc

SEQ ID NO: 114 - DNA, 20 bp, Artificial Sequence
  source: /note="Description of Artificial Sequence: Synthetic oligonucleotide"
gtcttgccttgcaggctctt

SEQ ID NO: 115 - DNA, 20 bp, Artificial Sequence
  source: /note="Description of Artificial Sequence: Synthetic oligonucleotide"
caggctgccctgcttgtcat

SEQ ID NO: 116 - DNA, 20 bp, Artificial Sequence
  source: /note="Description of Artificial Sequence: Synthetic oligonucleotide"
gggtaccaggcaagggtgcc

SEQ ID NO: 117 - DNA, 20 bp, Artificial Sequence
  source: /note="Description of Artificial Sequence: Synthetic oligonucleotide"
gcatgtcctcaggcaggacc

SEQ ID NO: 118 - DNA, 20 bp, Artificial Sequence
  source: /note="Description of Artificial Sequence: Synthetic oligonucleotide"
caggaggctcctgtgcacca

SEQ ID NO: 119 - DNA, 20 bp, Artificial Sequence
  source: /note="Description of Artificial Sequence: Synthetic oligonucleotide"
gcacagaccctgggctacct

SEQ ID NO: 120 - DNA, 20 bp, Artificial Sequence
  source: /note="Description of Artificial Sequence: Synthetic oligonucleotide"
acaggaggctcctgtgcacc

SEQ ID NO: 121 - DNA, 20 bp, Artificial Sequence
  source: /note="Description of Artificial Sequence: Synthetic oligonucleotide"
ttcctgtctgaggctgcctt

SEQ ID NO: 122 - DNA, 20 bp, Artificial Sequence
  source: /note="Description of Artificial Sequence: Synthetic oligonucleotide"
ttggtcttgccttgcaggct

SEQ ID NO: 123 - DNA, 20 bp, Artificial Sequence
  source: /note="Description of Artificial Sequence: Synthetic oligonucleotide"
cttggtcttgccttgcaggc

SEQ ID NO: 124 - DNA, 20 bp, Artificial Sequence
  source: /note="Description of Artificial Sequence: Synthetic oligonucleotide"
aggaggctcctgtgcaccag

SEQ ID NO: 125 - DNA, 20 bp, Artificial Sequence
  source: /note="Description of Artificial Sequence: Synthetic oligonucleotide"
gcacttgtccagtgctccag

SEQ ID NO: 126 - DNA, 20 bp, Artificial Sequence
  source: /note="Description of Artificial Sequence: Synthetic oligonucleotide"
gctcctgtgcaccagcaagt

SEQ ID NO: 127 - DNA, 20 bp, Artificial Sequence
  source: /note="Description of Artificial Sequence: Synthetic oligonucleotide"
cccactgggtttgccaccag

SEQ ID NO: 128 - DNA, 20 bp, Artificial Sequence
  source: /note="Description of Artificial Sequence: Synthetic oligonucleotide"
gaggtgggccatgagggtgg

SEQ ID NO: 129 - DNA, 20 bp, Artificial Sequence
  source: /note="Description of Artificial Sequence: Synthetic oligonucleotide"
ggaggtgggccatgagggtg

SEQ ID NO: 130 - DNA, 20 bp, Artificial Sequence
  source: /note="Description of Artificial Sequence: Synthetic oligonucleotide"
tggaggtgggccatgagggt

SEQ ID NO: 131 - DNA, 20 bp, Artificial Sequence
  source: /note="Description of Artificial Sequence: Synthetic oligonucleotide"
ccactgggtttgccaccagt

SEQ ID NO: 132 - DNA, 20 bp, Artificial Sequence
  source: /note="Description of Artificial Sequence: Synthetic oligonucleotide"
tgcacttgtccagtgctcca

SEQ ID NO: 133 - DNA, 20 bp, Artificial Sequence
  source: /note="Description of Artificial Sequence: Synthetic oligonucleotide"
ccttggtcttgccttgcagg

SEQ ID NO: 134 - DNA, 20 bp, Artificial Sequence
  source: /note="Description of Artificial Sequence: Synthetic oligonucleotide"
gatggcactcatccctggct

SEQ ID NO: 135 - DNA, 20 bp, Artificial Sequence
  source: /note="Description of Artificial Sequence: Synthetic oligonucleotide"
gcccagacccaggcccaaac

SEQ ID NO: 136 - DNA, 20 bp, Artificial Sequence
  source: /note="Description of Artificial Sequence: Synthetic oligonucleotide"
caggctcttgatggcagcct

SEQ ID NO: 137 - DNA, 20 bp, Artificial Sequence
  source: /note="Description of Artificial Sequence: Synthetic oligonucleotide"
ggctcctgtgcaccagcaag

SEQ ID NO: 138 - DNA, 20 bp, Artificial Sequence
  source: /note="Description of Artificial Sequence: Synthetic oligonucleotide"
aggctcctgtgcaccagcaa

SEQ ID NO: 139 - DNA, 20 bp, Artificial Sequence
  source: /note="Description of Artificial Sequence: Synthetic oligonucleotide"
acagcctgcatgtcctcagg

SEQ ID NO: 140 - DNA, 20 bp, Artificial Sequence
  source: /note="Description of Artificial Sequence: Synthetic oligonucleotide"
tgcccagacccaggcccaaa

SEQ ID NO: 141 - DNA, 20 bp, Artificial Sequence
  source: /note="Description of Artificial Sequence: Synthetic oligonucleotide"
gcatgcacttgtccagtgct

SEQ ID NO: 142 - DNA, 20 bp, Artificial Sequence
  source: /note="Description of Artificial Sequence: Synthetic oligonucleotide"
catgtcctcaggcaggacct

SEQ ID NO: 143 - DNA, 20 bp, Artificial Sequence
  source: /note="Description of Artificial Sequence: Synthetic oligonucleotide"
atgcacttgtccagtgctcc

SEQ ID NO: 144 - DNA, 20 bp, Artificial Sequence
  source: /note="Description of Artificial Sequence: Synthetic oligonucleotide"
cccaggcccttgctcagaat

SEQ ID NO: 145 - DNA, 20 bp, Artificial Sequence
  source: /note="Description of Artificial Sequence: Synthetic oligonucleotide"
ggccagaccaggaaggagcc

SEQ ID NO: 146 - DNA, 20 bp, Artificial Sequence
  source: /note="Description of Artificial Sequence: Synthetic oligonucleotide"
cacagaccctgggctacctc

SEQ ID NO: 147 - DNA, 20 bp, Artificial Sequence
  source: /note="Description of Artificial Sequence: Synthetic oligonucleotide"
ctggtgtcagagcctgcaga

SEQ ID NO: 148 - DNA, 20 bp, Artificial Sequence
  source: /note="Description of Artificial Sequence: Synthetic oligonucleotide"
agggtaccaggcaagggtgc

SEQ ID NO: 149 - DNA, 20 bp, Artificial Sequence
  source: /note="Description of Artificial Sequence: Synthetic oligonucleotide"
ggcccaaacaggaggctcct

SEQ ID NO: 150 - DNA, 20 bp, Artificial Sequence
  source: /note="Description of Artificial Sequence: Synthetic oligonucleotide"
agagcctgcagatgagtccc

SEQ ID NO: 151 - DNA, 20 bp, Artificial Sequence
  source: /note="Description of Artificial Sequence: Synthetic oligonucleotide"
atggcactcatccctggctg

SEQ ID NO: 152 - DNA, 20 bp, Artificial Sequence
  source: /note="Description of Artificial Sequence: Synthetic oligonucleotide"
tcttgccttgcaggctcttg

SEQ ID NO: 153 - DNA, 20 bp, Artificial Sequence
  source: /note="Description of Artificial Sequence: Synthetic oligonucleotide"
aactgagcagggaccctccc

SEQ ID NO: 154 - DNA, 20 bp, Artificial Sequence
  source: /note="Description of Artificial Sequence: Synthetic oligonucleotide"
ccttgcaggctcttgatggc

SEQ ID NO: 155 - DNA, 20 bp, Artificial Sequence
  source: /note="Description of Artificial Sequence: Synthetic oligonucleotide"
gccttgcaggctcttgatgg

SEQ ID NO: 156 - DNA, 20 bp, Artificial Sequence
  source: /note="Description of Artificial Sequence: Synthetic oligonucleotide"
tcctgtgcaccagcaagtgc

SEQ ID NO: 157 - DNA, 20 bp, Artificial Sequence
  source: /note="Description of Artificial Sequence: Synthetic oligonucleotide"
tgcaggctcttgatggcagc

SEQ ID NO: 158 - DNA, 20 bp, Artificial Sequence
  source: /note="Description of Artificial Sequence: Synthetic oligonucleotide"
gccatgatggcactcatccc

SEQ ID NO: 159 - DNA, 20 bp, Artificial Sequence
  source: /note="Description of Artificial Sequence: Synthetic oligonucleotide"
gccagaccaggaaggagcct

SEQ ID NO: 160 - DNA, 20 bp, Artificial Sequence
  source: /note="Description of Artificial Sequence: Synthetic oligonucleotide"
cttgccttgcaggctcttga

SEQ ID NO: 161 - DNA, 20 bp, Artificial Sequence
  source: /note="Description of Artificial Sequence: Synthetic oligonucleotide"
gtgcaccagcaagtgcagca

SEQ ID NO: 162 - DNA, 20 bp, Artificial Sequence
  source: /note="Description of Artificial Sequence: Synthetic oligonucleotide"
tccacagagctgcaggttct

SEQ ID NO: 163 - DNA, 20 bp, Artificial Sequence
  source: /note="Description of Artificial Sequence: Synthetic oligonucleotide"
actggtgtcagagcctgcag

SEQ ID NO: 164 - DNA, 20 bp, Artificial Sequence
  source: /note="Description of Artificial Sequence: Synthetic oligonucleotide"
tgatggcactcatccctggc

SEQ ID NO: 165 - DNA, 20 bp, Artificial Sequence
  source: /note="Description of Artificial Sequence: Synthetic oligonucleotide"
cacagcctgcatgtcctcag

SEQ ID NO: 166 - DNA, 20 bp, Artificial Sequence
  source: /note="Description of Artificial Sequence: Synthetic oligonucleotide"
gggccagaccaggaaggagc

SEQ ID NO: 167 - DNA, 20 bp, Artificial Sequence
  source: /note="Description of Artificial Sequence: Synthetic oligonucleotide"
tgcatgtcctcaggcaggac

SEQ ID NO: 168 - DNA, 20 bp, Artificial Sequence
  source: /note="Description of Artificial Sequence: Synthetic oligonucleotide"
cctgtgcaccagcaagtgca

SEQ ID NO: 169 - DNA, 20 bp, Artificial Sequence
  source: /note="Description of Artificial Sequence: Synthetic oligonucleotide"
gcctgggtttattggagggt

SEQ ID NO: 170 - DNA, 20 bp, Artificial Sequence
  source: /note="Description of Artificial Sequence: Synthetic oligonucleotide"
cctctttccacagagctgca

SEQ ID NO: 171 - DNA, 20 bp, Artificial Sequence
  source: /note="Description of Artificial Sequence: Synthetic oligonucleotide"
gggtgcagcaccctccaaac

SEQ ID NO: 172 - DNA, 20 bp, Artificial Sequence
  source: /note="Description of Artificial Sequence: Synthetic oligonucleotide"
ggtttgccaccagtacaggg

SEQ ID NO: 173 - DNA, 20 bp, Artificial Sequence
  source: /note="Description of Artificial Sequence: Synthetic oligonucleotide"
gggtttgccaccagtacagg

SEQ ID NO: 174 - DNA, 20 bp, Artificial Sequence
  source: /note="Description of Artificial Sequence: Synthetic oligonucleotide"
gccagcacagccaagagtgg

SEQ ID NO: 175 - DNA, 20 bp, Artificial Sequence
  source: /note="Description of Artificial Sequence: Synthetic oligonucleotide"
ggccagcacagccaagagtg

SEQ ID NO: 176 - DNA, 20 bp, Artificial Sequence
  source: /note="Description of Artificial Sequence: Synthetic oligonucleotide"
tggccagcacagccaagagt

SEQ ID NO: 177 - DNA, 20 bp, Artificial Sequence
  source: /note="Description of Artificial Sequence: Synthetic oligonucleotide"
aggcccaaacaggaggctcc

SEQ ID NO: 178 - DNA, 20 bp, Artificial Sequence
  source: /note="Description of Artificial Sequence: Synthetic oligonucleotide"
gaacttgcctgcttccagct

SEQ ID NO: 179 - DNA, 20 bp, Artificial Sequence
  source: /note="Description of Artificial Sequence: Synthetic oligonucleotide"
gggcacccatgacactctgg

SEQ ID NO: 180 - DNA, 20 bp, Artificial Sequence
  source: /note="Description of Artificial Sequence: Synthetic oligonucleotide"
aagcacagcctgcatgtcct

SEQ ID NO: 181 - DNA, 20 bp, Artificial Sequence
  source: /note="Description of Artificial Sequence: Synthetic oligonucleotide"
gcagcaccctccaaactggt

SEQ ID NO: 182 - DNA, 20 bp, Artificial Sequence
  source: /note="Description of Artificial Sequence: Synthetic oligonucleotide"
ggtgcagcaccctccaaact

SEQ ID NO: 183 - DNA, 20 bp, Artificial Sequence
  source: /note="Description of Artificial Sequence: Synthetic oligonucleotide"
ccctctgaacccagtggagg

SEQ ID NO: 184 - DNA, 20 bp, Artificial Sequence
  source: /note="Description of Artificial Sequence: Synthetic oligonucleotide"
tgtgcaccagcaagtgcagc

SEQ ID NO: 185 - DNA, 20 bp, Artificial Sequence
  source: /note="Description of Artificial Sequence: Synthetic oligonucleotide"
ctttccacagagctgcaggt

SEQ ID NO: 186 - DNA, 20 bp, Artificial Sequence
  source: /note="Description of Artificial Sequence: Synthetic oligonucleotide"
ggtgtcagagcctgcagatg

SEQ ID NO: 187 - DNA, 20 bp, Artificial Sequence
  source: /note="Description of Artificial Sequence: Synthetic oligonucleotide"
tggtgtcagagcctgcagat

SEQ ID NO: 188 - DNA, 20 bp, Artificial Sequence
  source: /note="Description of Artificial Sequence: Synthetic oligonucleotide"
ccaggcccaaacaggaggct

SEQ ID NO: 189 - DNA, 20 bp, Artificial Sequence
  source: /note="Description of Artificial Sequence: Synthetic oligonucleotide"
agtgtagcatttctctggcc

SEQ ID NO: 190 - DNA, 20 bp, Artificial Sequence
  source: /note="Description of Artificial Sequence: Synthetic oligonucleotide"
acagagctgcaggttctgtc

SEQ ID NO: 191 - DNA, 20 bp, Artificial Sequence
  source: /note="Description of Artificial Sequence: Synthetic oligonucleotide"
catgcacttgtccagtgctc

SEQ ID NO: 192 - DNA, 20 bp, Artificial Sequence
  source: /note="Description of Artificial Sequence: Synthetic oligonucleotide"
ttccacagagctgcaggttc

SEQ ID NO: 193 - DNA, 20 bp, Artificial Sequence
  source: /note="Description of Artificial Sequence: Synthetic oligonucleotide"
gaactgagcagggaccctcc

SEQ ID NO: 194 - DNA, 20 bp, Artificial Sequence
  source: /note="Description of Artificial Sequence: Synthetic oligonucleotide"
ctgggtttgccaccagtaca

SEQ ID NO: 195 - DNA, 20 bp, Artificial Sequence
  source: /note="Description of Artificial Sequence: Synthetic oligonucleotide"
cactgggtttgccaccagta

SEQ ID NO: 196 - DNA, 20 bp, Artificial Sequence
  source: /note="Description of Artificial Sequence: Synthetic oligonucleotide"
gtgcagcaaagctggctgca

SEQ ID NO: 197 - DNA, 20 bp, Artificial Sequence
  source: /note="Description of Artificial Sequence: Synthetic oligonucleotide"
aacttgcctgcttccagctt

SEQ ID NO: 198 - DNA, 20 bp, Artificial Sequence
  source: /note="Description of Artificial Sequence: Synthetic oligonucleotide"
ttgccttgcaggctcttgat

SEQ ID NO: 199 - DNA, 20 bp, Artificial Sequence
  source: /note="Description of Artificial Sequence: Synthetic oligonucleotide"
gcaccctccaaactggtgtc

SEQ ID NO: 200 - DNA, 20 bp, Artificial Sequence
  source: /note="Description of Artificial Sequence: Synthetic oligonucleotide"
ccacagagctgcaggttctg

SEQ ID NO: 201 - DNA, 20 bp, Artificial Sequence
  source: /note="Description of Artificial Sequence: Synthetic oligonucleotide"
gcctgaggcacagcaccaag

SEQ ID NO: 202 - DNA, 20 bp, Artificial Sequence
  source: /note="Description of Artificial Sequence: Synthetic oligonucleotide"
gcccaaacaggaggctcctg

SEQ ID NO: 203 - DNA, 20 bp, Artificial Sequence
  source: /note="Description of Artificial Sequence: Synthetic oligonucleotide"
cagagcctgcagatgagtcc

SEQ ID NO: 204 - DNA, 20 bp, Artificial Sequence
  source: /note="Description of Artificial Sequence: Synthetic oligonucleotide"
ccatgatggcactcatccct

SEQ ID NO: 205 - DNA, 20 bp, Artificial Sequence
  source: /note="Description of Artificial Sequence: Synthetic oligonucleotide"
ctcctgtgcaccagcaagtg

SEQ ID NO: 206 - DNA, 20 bp, Artificial Sequence
  source: /note="Description of Artificial Sequence: Synthetic oligonucleotide"
gaagagcccaggttgtctca

SEQ ID NO: 207 - DNA, 20 bp, Artificial Sequence
  source: /note="Description of Artificial Sequence: Synthetic oligonucleotide"
cttgcaggctcttgatggca

SEQ ID NO: 208 - DNA, 20 bp, Artificial Sequence
  source: /note="Description of Artificial Sequence: Synthetic oligonucleotide"
ggcacccatgacactctgga

SEQ ID NO: 209 - DNA, 20 bp, Artificial Sequence
  source: /note="Description of Artificial Sequence: Synthetic oligonucleotide"
gtcagagcctgcagatgagt

SEQ ID NO: 210 - DNA, 20 bp, Artificial Sequence
  source: /note="Description of Artificial Sequence: Synthetic oligonucleotide"
tcaggactttgcctctttcc

SEQ ID NO: 211 - DNA, 20 bp, Artificial Sequence
  source: /note="Description of Artificial Sequence: Synthetic oligonucleotide"
acagactctggcagggaggg

SEQ ID NO: 212 - DNA, 20 bp, Artificial Sequence
  source: /note="Description of Artificial Sequence: Synthetic oligonucleotide"
actgggtttgccaccagtac

SEQ ID NO: 213 - DNA, 20 bp, Artificial Sequence
  source: /note="Description of Artificial Sequence: Synthetic oligonucleotide"
ggaagtcacagcagggctgg

SEQ ID NO: 214 - DNA, 20 bp, Artificial Sequence
  source: /note="Description of Artificial Sequence: Synthetic oligonucleotide"
tgccttgcaggctcttgatg

SEQ ID NO: 215 - DNA, 20 bp, Artificial Sequence
  source: /note="Description of Artificial Sequence: Synthetic oligonucleotide"
ccagcacagccaagagtggg

SEQ ID NO: 216 - DNA, 20 bp, Artificial Sequence
  source: /note="Description of Artificial Sequence: Synthetic oligonucleotide"
ggactttgcctctttccaca

SEQ ID NO: 217 - DNA, 20 bp, Artificial Sequence
  source: /note="Description of Artificial Sequence: Synthetic oligonucleotide"
gctgcttttactgccatggg

SEQ ID NO: 218 - DNA, 20 bp, Artificial Sequence
  source: /note="Description of Artificial Sequence: Synthetic oligonucleotide"
agtgcagcaaagctggctgc

SEQ ID NO: 219 - DNA, 20 bp, Artificial Sequence
  source: /note="Description of Artificial Sequence: Synthetic oligonucleotide"
gtgtcagagcctgcagatga

SEQ ID NO: 220 - DNA, 20 bp, Artificial Sequence
  source: /note="Description of Artificial Sequence: Synthetic oligonucleotide"
caggactttgcctctttcca

SEQ ID NO: 221 - DNA, 20 bp, Artificial Sequence
  source: /note="Description of Artificial Sequence: Synthetic oligonucleotide"
ggcacagcaccaaggcatgg

SEQ ID NO: 222 - DNA, 20 bp, Artificial Sequence
  source: /note="Description of Artificial Sequence: Synthetic oligonucleotide"
gggaatgcagaaccaccccc

SEQ ID NO: 223 - DNA, 20 bp, Artificial Sequence
  source: /note="Description of Artificial Sequence: Synthetic oligonucleotide"
ccaggcccttgctcagaata

SEQ ID NO: 224 - DNA, 20 bp, Artificial Sequence
  source: /note="Description of Artificial Sequence: Synthetic oligonucleotide"
ctgaggcacagcaccaaggc

SEQ ID NO: 225 - DNA, 20 bp, Artificial Sequence
  source: /note="Description of Artificial Sequence: Synthetic oligonucleotide"
aacaggaggctcctgtgcac

SEQ ID NO: 226 - DNA, 20 bp, Artificial Sequence
  source: /note="Description of Artificial Sequence: Synthetic oligonucleotide"
agaagagcccaggttgtctc

SEQ ID NO: 227 - DNA, 20 bp, Artificial Sequence
  source: /note="Description of Artificial Sequence: Synthetic oligonucleotide"
tttccacagagctgcaggtt

SEQ ID NO: 228 - DNA, 20 bp, Artificial Sequence
  source: /note="Description of Artificial Sequence: Synthetic oligonucleotide"
tgccttttcaggactttgcc

SEQ ID NO: 229 - DNA, 20 bp, Artificial Sequence
  source: /note="Description of Artificial Sequence: Synthetic oligonucleotide"
agccatgatggcactcatcc

SEQ ID NO: 230 - DNA, 20 bp, Artificial Sequence
  source: /note="Description of Artificial Sequence: Synthetic oligonucleotide"
tctttccacagagctgcagg

SEQ ID NO: 231 - DNA, 20 bp, Artificial Sequence
  source: /note="Description of Artificial Sequence: Synthetic oligonucleotide"
agcaccctccaaactggtgt

SEQ ID NO: 232 - DNA, 20 bp, Artificial Sequence
  source: /note="Description of Artificial Sequence: Synthetic oligonucleotide"
aagagcccaggttgtctcag

SEQ ID NO: 233 - DNA, 20 bp, Artificial Sequence
  source: /note="Description of Artificial Sequence: Synthetic oligonucleotide"
caggcccaaacaggaggctc

SEQ ID NO: 234 - DNA, 20 bp, Artificial Sequence
  source: /note="Description of Artificial Sequence: Synthetic oligonucleotide"
cctccaccagttggaagacc

SEQ ID NO: 235 - DNA, 20 bp, Artificial Sequence
  source: /note="Description of Artificial Sequence: Synthetic oligonucleotide"
acccaggcccaaacaggagg

SEQ ID NO: 236 - DNA, 20 bp, Artificial Sequence
  source: /note="Description of Artificial Sequence: Synthetic oligonucleotide"
cctctgaacccagtggagga

SEQ ID NO: 237 - DNA, 20 bp, Artificial Sequence
  source: /note="Description of Artificial Sequence: Synthetic oligonucleotide"
aggactttgcctctttccac

SEQ ID NO: 238 - DNA, 20 bp, Artificial Sequence
  source: /note="Description of Artificial Sequence: Synthetic oligonucleotide"
tccctctccagatactgagg

SEQ ID NO: 239 - DNA, 20 bp, Artificial Sequence
  source: /note="Description of Artificial Sequence: Synthetic oligonucleotide"
tgggtttgccaccagtacag

SEQ ID NO: 240 - DNA, 20 bp, Artificial Sequence
  source: /note="Description of Artificial Sequence: Synthetic oligonucleotide"
cagaatacagtgcccaggcc

SEQ ID NO: 241 - DNA, 20 bp, Artificial Sequence
  source: /note="Description of Artificial Sequence: Synthetic oligonucleotide"
taagcacagcctgcatgtcc

SEQ ID NO: 242 - DNA, 20 bp, Artificial Sequence
  source: /note="Description of Artificial Sequence: Synthetic oligonucleotide"
cctgaggcacagcaccaagg

SEQ ID NO: 243 - DNA, 20 bp, Artificial Sequence
  source: /note="Description of Artificial Sequence: Synthetic oligonucleotide"
ccttttcaggactttgcctc

SEQ ID NO: 244 - DNA, 20 bp, Artificial Sequence
  source: /note="Description of Artificial Sequence: Synthetic oligonucleotide"
agcctgggtttattggaggg

SEQ ID NO: 245 - DNA, 20 bp, Artificial Sequence
  source: /note="Description of Artificial Sequence: Synthetic oligonucleotide"
ctgtgcaccagcaagtgcag

SEQ ID NO: 246 - DNA, 20 bp, Artificial Sequence
  source: /note="Description of Artificial Sequence: Synthetic oligonucleotide"
gaggcacagcaccaaggcat

SEQ ID NO: 247 - DNA, 20 bp, Artificial Sequence
  source: /note="Description of Artificial Sequence: Synthetic oligonucleotide"
ccagacccaggcccaaacag

SEQ ID NO: 248 - DNA, 20 bp, Artificial Sequence
  source: /note="Description of Artificial Sequence: Synthetic oligonucleotide"
ggccaagacagactctggca

SEQ ID NO: 249 - DNA, 20 bp, Artificial Sequence
  source: /note="Description of Artificial Sequence: Synthetic oligonucleotide"
gtgcagcaccctccaaactg

SEQ ID NO: 250 - DNA, 20 bp, Artificial Sequence
  source: /note="Description of Artificial Sequence: Synthetic oligonucleotide"
ccctctccagatactgagga

SEQ ID NO: 251 - DNA, 20 bp, Artificial Sequence
  source: /note="Description of Artificial Sequence: Synthetic oligonucleotide"
gcctgggcattgccttaatt

SEQ ID NO: 252 - DNA, 20 bp, Artificial Sequence
  source: /note="Description of Artificial Sequence: Synthetic oligonucleotide"
tgaggcacagcaccaaggca

SEQ ID NO: 253 - DNA, 20 bp, Artificial Sequence
  source: /note="Description of Artificial Sequence: Synthetic oligonucleotide"
ctctttccacagagctgcag

SEQ ID NO: 254 - DNA, 20 bp, Artificial Sequence
  source: /note="Description of Artificial Sequence: Synthetic oligonucleotide"
gtaagcacagcctgcatgtc

SEQ ID NO: 255 - DNA, 20 bp, Artificial Sequence
  source: /note="Description of Artificial Sequence: Synthetic oligonucleotide"
ctccttatgcacccaatcct

SEQ ID NO: 256 - DNA, 20 bp, Artificial Sequence
  source: /note="Description of Artificial Sequence: Synthetic oligonucleotide"
aatgcagaaccacccccacc

SEQ ID NO: 257 - DNA, 20 bp, Artificial Sequence
  source: /note="Description of Artificial Sequence: Synthetic oligonucleotide"
gcccagcctcagaatgattc

SEQ ID NO: 258 - DNA, 20 bp, Artificial Sequence
  source: /note="Description of Artificial Sequence: Synthetic oligonucleotide"
ttgcaggctcttgatggcag

SEQ ID NO: 259 - DNA, 20 bp, Artificial Sequence
  source: /note="Description of Artificial Sequence: Synthetic oligonucleotide"
gccccaaacctggagtgaga

SEQ ID NO: 260 - DNA, 20 bp, Artificial Sequence
  source: /note="Description of Artificial Sequence: Synthetic oligonucleotide"
gagtggaaggaaggagcccc

SEQ ID NO: 261 - DNA, 20 bp, Artificial Sequence
  source: /note="Description of Artificial Sequence: Synthetic oligonucleotide"
gagtgtagcatttctctggc

SEQ ID NO: 262 - DNA, 20 bp, Artificial Sequence
  source: /note="Description of Artificial Sequence: Synthetic oligonucleotide"
tcagagcctgcagatgagtc

SEQ ID NO: 263 - DNA, 20 bp, Artificial Sequence
  source: /note="Description of Artificial Sequence: Synthetic oligonucleotide"
tctccttatgcacccaatcc

SEQ ID NO: 264 - DNA, 20 bp, Artificial Sequence
  source: /note="Description of Artificial Sequence: Synthetic oligonucleotide"
ggaatgcagaaccaccccca

SEQ ID NO: 265 - DNA, 20 bp, Artificial Sequence
  source: /note="Description of Artificial Sequence: Synthetic oligonucleotide"
agtggaaggaaggagcccca

SEQ ID NO: 266 - DNA, 20 bp, Artificial Sequence
  source: /note="Description of Artificial Sequence: Synthetic oligonucleotide"
cccaatccttgcagtcatgg

SEQ ID NO: 267 - DNA, 20 bp, Artificial Sequence
  source: /note="Description of Artificial Sequence: Synthetic oligonucleotide"
atgatggcactcatccctgg

SEQ ID NO: 268 - DNA, 20 bp, Artificial Sequence
  source: /note="Description of Artificial Sequence: Synthetic oligonucleotide"
tgcagcaccctccaaactgg

SEQ ID NO: 269 - DNA, 20 bp, Artificial Sequence
  source: /note="Description of Artificial Sequence: Synthetic oligonucleotide"
gacccaggcccaaacaggag

SEQ ID NO: 270 - DNA, 20 bp, Artificial Sequence
  source: /note="Description of Artificial Sequence: Synthetic oligonucleotide"
agacccaggcccaaacagga

SEQ ID NO: 271 - DNA, 20 bp, Artificial Sequence
  source: /note="Description of Artificial Sequence: Synthetic oligonucleotide"
gtctccagaactgagcaggg

SEQ ID NO: 272 - DNA, 20 bp, Artificial Sequence
  source: /note="Description of Artificial Sequence: Synthetic oligonucleotide"
tggttaggttggacccatgg

SEQ ID NO: 273 - DNA, 20 bp, Artificial Sequence
  source: /note="Description of Artificial Sequence: Synthetic oligonucleotide"
gaagggtaccaggcaagggt

SEQ ID NO: 274 - DNA, 20 bp, Artificial Sequence
  source: /note="Description of Artificial Sequence: Synthetic oligonucleotide"
cagacccaggcccaaacagg

SEQ ID NO: 275 - DNA, 20 bp, Artificial Sequence
  source: /note="Description of Artificial Sequence: Synthetic oligonucleotide"
gcacccatgacactctggat

SEQ ID NO: 276 - DNA, 20 bp, Artificial Sequence
  source: /note="Description of Artificial Sequence: Synthetic oligonucleotide"
actttgcctctttccacaga

SEQ ID NO: 277 - DNA, 20 bp, Artificial Sequence
  source: /note="Description of Artificial Sequence: Synthetic oligonucleotide"
gactttgcctctttccacag

SEQ ID NO: 278 - DNA, 20 bp, Artificial Sequence
  source: /note="Description of Artificial Sequence: Synthetic oligonucleotide"
agccccaaacctggagtgag

SEQ ID NO: 279 - DNA, 20 bp, Artificial Sequence
  source: /note="Description of Artificial Sequence: Synthetic oligonucleotide"
cacccaatccttgcagtcat

SEQ ID NO: 280 - DNA, 20 bp, Artificial Sequence
  source: /note="Description of Artificial Sequence: Synthetic oligonucleotide"
ctccaccagttggaagacct

SEQ ID NO: 281 - DNA, 20 bp, Artificial Sequence
  source: /note="Description of Artificial Sequence: Synthetic oligonucleotide"
caccctccaaactggtgtca

SEQ ID NO: 282 - DNA, 20 bp, Artificial Sequence
  source: /note="Description of Artificial Sequence: Synthetic oligonucleotide"
agaactgagcagggaccctc

SEQ ID NO: 283 - DNA, 20 bp, Artificial Sequence
  source: /note="Description of Artificial Sequence: Synthetic oligonucleotide"
tggccaagacagactctggc

SEQ ID NO: 284 - DNA, 20 bp, Artificial Sequence
  source: /note="Description of Artificial Sequence: Synthetic oligonucleotide"
ggagtggaaggaaggagccc

SEQ ID NO: 285 - DNA, 20 bp, Artificial Sequence
  source: /note="Description of Artificial Sequence: Synthetic oligonucleotide"
ctgaacccagtggaggaggg

SEQ ID NO: 286 - DNA, 20 bp, Artificial Sequence
  source: /note="Description of Artificial Sequence: Synthetic oligonucleotide"
ccctccaaactggtgtcaga

SEQ ID NO: 287 - DNA, 20 bp, Artificial Sequence
  source: /note="Description of Artificial Sequence: Synthetic oligonucleotide"
aggcacagcaccaaggcatg

SEQ ID NO: 288 - DNA, 20 bp, Artificial Sequence
  source: /note="Description of Artificial Sequence: Synthetic oligonucleotide"
ctttgcctctttccacagag

SEQ ID NO: 289 - DNA, 20 bp, Artificial Sequence
  source: /note="Description of Artificial Sequence: Synthetic oligonucleotide"
gcccttgctcagaatacagt

SEQ ID NO: 290 - DNA, 20 bp, Artificial Sequence
  source: /note="Description of Artificial Sequence: Synthetic oligonucleotide"
ctggttaggttggacccatg

SEQ ID NO: 291 - DNA, 20 bp, Artificial Sequence
  source: /note="Description of Artificial Sequence: Synthetic oligonucleotide"
tggaagtcacagcagggctg

SEQ ID NO: 292 - DNA, 20 bp, Artificial Sequence
  source: /note="Description of Artificial Sequence: Synthetic oligonucleotide"
agcccagcctcagaatgatt

SEQ ID NO: 293 - DNA, 20 bp, Artificial Sequence
  source: /note="Description of Artificial Sequence: Synthetic oligonucleotide"
agtaagcacagcctgcatgt

SEQ ID NO: 294 - DNA, 20 bp, Artificial Sequence
  source: /note="Description of Artificial Sequence: Synthetic oligonucleotide"
tccaccagttggaagacctc

SEQ ID NO: 295 - DNA, 20 bp, Artificial Sequence
  source: /note="Description of Artificial Sequence: Synthetic oligonucleotide"
tcctccaccagttggaagac

SEQ ID NO: 296 - DNA, 20 bp, Artificial Sequence
  source: /note="Description of Artificial Sequence: Synthetic oligonucleotide"
cagcaccctccaaactggtg

SEQ ID NO: 297 - DNA, 20 bp, Artificial Sequence
  source: /note="Description of Artificial Sequence: Synthetic oligonucleotide"
tggcaaaggtgatgcaggcc

SEQ ID NO: 298 - DNA, 20 bp, Artificial Sequence
  source: /note="Description of Artificial Sequence: Synthetic oligonucleotide"
gtgccattggtagagtagga

SEQ ID NO: 299 - DNA, 20 bp, Artificial Sequence
  source: /note="Description of Artificial Sequence: Synthetic oligonucleotide"
tccttatgcacccaatcctt

SEQ ID NO: 300 - DNA, 20 bp, Artificial Sequence
  source: /note="Description of Artificial Sequence: Synthetic oligonucleotide"
gagccatgatggcactcatc

SEQ ID NO: 301 - DNA, 20 bp, Artificial Sequence
  source: /note="Description of Artificial Sequence: Synthetic oligonucleotide"
cagaactgagcagggaccct

SEQ ID NO: 302 - DNA, 20 bp, Artificial Sequence
  source: /note="Description of Artificial Sequence: Synthetic oligonucleotide"
ggaaggagccccaaacctgg

SEQ ID NO: 303 - DNA, 20 bp, Artificial Sequence
  source: /note="Description of Artificial Sequence: Synthetic oligonucleotide"
gtgattacagggcaaggcca

SEQ ID NO: 304 - DNA, 20 bp, Artificial Sequence
  source: /note="Description of Artificial Sequence: Synthetic oligonucleotide"
tcagaatacagtgcccaggc

SEQ ID NO: 305 - DNA, 20 bp, Artificial Sequence
  source: /note="Description of Artificial Sequence: Synthetic oligonucleotide"
ggcattgccttaattcctgt

SEQ ID NO: 306 - DNA, 20 bp, Artificial Sequence
  source: /note="Description of Artificial Sequence: Synthetic oligonucleotide"
tgcaccagcaagtgcagcaa

SEQ ID NO: 307 - DNA, 20 bp, Artificial Sequence
  source: /note="Description of Artificial Sequence: Synthetic oligonucleotide"
ttccctctccagatactgag

SEQ ID NO: 308 - DNA, 20 bp, Artificial Sequence
  source: /note="Description of Artificial Sequence: Synthetic oligonucleotide"
ttcaggactttgcctctttc

SEQ ID NO: 309 - DNA, 20 bp, Artificial Sequence
  source: /note="Description of Artificial Sequence: Synthetic oligonucleotide"
gcaagtgcagcaaagctggc

SEQ ID NO: 310 - DNA, 20 bp, Artificial Sequence
  source: /note="Description of Artificial Sequence: Synthetic oligonucleotide"
tccagaactgagcagggacc

SEQ ID NO: 311 - DNA, 20 bp, Artificial Sequence
  source: /note="Description of Artificial Sequence: Synthetic oligonucleotide"
catgatggcactcatccctg

SEQ ID NO: 312 - DNA, 20 bp, Artificial Sequence
  source: /note="Description of Artificial Sequence: Synthetic oligonucleotide"
accctccaaactggtgtcag

SEQ ID NO: 313 - DNA, 20 bp, Artificial Sequence
  source: /note="Description of Artificial Sequence: Synthetic oligonucleotide"
ccaaactggtgtcagagcct

SEQ ID NO: 314 - DNA, 20 bp, Artificial Sequence
  source: /note="Description of Artificial Sequence: Synthetic oligonucleotide"
agggaatgcagaaccacccc

SEQ ID NO: 315 - DNA, 20 bp, Artificial Sequence
  source: /note="Description of Artificial Sequence: Synthetic oligonucleotide"
ggcccttgctcagaatacag

SEQ ID NO: 316 - DNA, 20 bp, Artificial Sequence
  source: /note="Description of Artificial Sequence: Synthetic oligonucleotide"
aggcccttgctcagaataca

SEQ ID NO: 317 - DNA, 20 bp, Artificial Sequence
  source: /note="Description of Artificial Sequence: Synthetic oligonucleotide"
caggcccttgctcagaatac

SEQ ID NO: 318 - DNA, 20 bp, Artificial Sequence
  source: /note="Description of Artificial Sequence: Synthetic oligonucleotide"
aaacaggaggctcctgtgca

SEQ ID NO: 319 - DNA, 20 bp, Artificial Sequence
  source: /note="Description of Artificial Sequence: Synthetic oligonucleotide"
ggagtgtagcatttctctgg

SEQ ID NO: 320 - DNA, 20 bp, Artificial Sequence
  source: /note="Description of Artificial Sequence: Synthetic oligonucleotide"
gggagtgtagcatttctctg

SEQ ID NO: 321 - DNA, 20 bp, Artificial Sequence
  source: /note="Description of Artificial Sequence: Synthetic oligonucleotide"
gaatgcagaaccacccccac

SEQ ID NO: 322 - DNA, 20 bp, Artificial Sequence
  source: /note="Description of Artificial Sequence: Synthetic oligonucleotide"
tgtcagagcctgcagatgag

SEQ ID NO: 323 - DNA, 20 bp, Artificial Sequence
  source: /note="Description of Artificial Sequence: Synthetic oligonucleotide"
tctgaacccagtggaggagg

SEQ ID NO: 324 - DNA, 20 bp, Artificial Sequence
  source: /note="Description of Artificial Sequence: Synthetic oligonucleotide"
agacagactctggcagggag

SEQ ID NO: 325 - DNA, 20 bp, Artificial Sequence
  source: /note="Description of Artificial Sequence: Synthetic oligonucleotide"
gccaagacagactctggcag

SEQ ID NO: 326 - DNA, 20 bp, Artificial Sequence
  source: /note="Description of Artificial Sequence: Synthetic oligonucleotide"
gctcagaatacagtgcccag

SEQ ID NO: 327 - DNA, 20 bp, Artificial Sequence
  source: /note="Description of Artificial Sequence: Synthetic oligonucleotide"
gggagtggaaggaaggagcc

SEQ ID NO: 328 - DNA, 20 bp, Artificial Sequence
  source: /note="Description of Artificial Sequence: Synthetic oligonucleotide"
tagcccagcctcagaatgat

SEQ ID NO: 329 - DNA, 20 bp, Artificial Sequence
  source: /note="Description of Artificial Sequence: Synthetic oligonucleotide"
atagcccagcctcagaatga

SEQ ID NO: 330 - DNA, 20 bp, Artificial Sequence
  source: /note="Description of Artificial Sequence: Synthetic oligonucleotide"
tccaaactggtgtcagagcc

SEQ ID NO: 331 - DNA, 20 bp, Artificial Sequence
  source: /note="Description of Artificial Sequence: Synthetic oligonucleotide"
acccaatccttgcagtcatg

SEQ ID NO: 332 - DNA, 20 bp, Artificial Sequence
  source: /note="Description of Artificial Sequence: Synthetic oligonucleotide"
cccagcctcagaatgattct

SEQ ID NO: 333 - DNA, 20 bp, Artificial Sequence
  source: /note="Description of Artificial Sequence: Synthetic oligonucleotide"
ccttaattcctgtctgaggc

SEQ ID NO: 334 - DNA, 20 bp, Artificial Sequence
  source: /note="Description of Artificial Sequence: Synthetic oligonucleotide"
gccttaattcctgtctgagg

SEQ ID NO: 335 - DNA, 20 bp, Artificial Sequence
  source: /note="Description of Artificial Sequence: Synthetic oligonucleotide"
agtgattacagggcaaggcc

SEQ ID NO: 336 - DNA, 20 bp, Artificial Sequence
  source: /note="Description of Artificial Sequence: Synthetic oligonucleotide"
cctgggcattgccttaattc

SEQ ID NO: 337 - DNA, 20 bp, Artificial Sequence
  source: /note="Description of Artificial Sequence: Synthetic oligonucleotide"
ttgccttttcaggactttgc

SEQ ID NO: 338 - DNA, 20 bp, Artificial Sequence
  source: /note="Description of Artificial Sequence: Synthetic oligonucleotide"
cttatgcacccaatccttgc

SEQ ID NO: 339 - DNA, 20 bp, Artificial Sequence
  source: /note="Description of Artificial Sequence: Synthetic oligonucleotide"
agtgccattggtagagtagg

SEQ ID NO: 340 - DNA, 20 bp, Artificial Sequence
  source: /note="Description of Artificial Sequence: Synthetic oligonucleotide"
ccaaacaggaggctcctgtg

SEQ ID NO: 341 - DNA, 20 bp, Artificial Sequence
  source: /note="Description of Artificial Sequence: Synthetic oligonucleotide"
aaactggtgtcagagcctgc

SEQ ID NO: 342 - DNA, 20 bp, Artificial Sequence
  source: /note="Description of Artificial Sequence: Synthetic oligonucleotide"
tctccagaactgagcaggga

SEQ ID NO: 343 - DNA, 20 bp, Artificial Sequence
  source: /note="Description of Artificial Sequence: Synthetic oligonucleotide"
agacaacccaatggcagggc

SEQ ID NO: 344 - DNA, 20 bp, Artificial Sequence
  source: /note="Description of Artificial Sequence: Synthetic oligonucleotide"
gaaggagccccaaacctgga

SEQ ID NO: 345 - DNA, 20 bp, Artificial Sequence
  source: /note="Description of Artificial Sequence: Synthetic oligonucleotide"
gtggaaggaaggagccccaa

SEQ ID NO: 346 - DNA, 20 bp, Artificial Sequence
  source: /note="Description of Artificial Sequence: Synthetic oligonucleotide"
gcattgccttaattcctgtc

SEQ ID NO: 347 - DNA, 20 bp, Artificial Sequence
  source: /note="Description of Artificial Sequence: Synthetic oligonucleotide"
ctctgaacccagtggaggag

SEQ ID NO: 348 - DNA, 20 bp, Artificial Sequence
  source: /note="Description of Artificial Sequence: Synthetic oligonucleotide"
agagccatgatggcactcat

SEQ ID NO: 349 - DNA, 20 bp, Artificial Sequence
  source: /note="Description of Artificial Sequence: Synthetic oligonucleotide"
gattacagggcaaggccaca

SEQ ID NO: 350 - DNA, 20 bp, Artificial Sequence
  source: /note="Description of Artificial Sequence: Synthetic oligonucleotide"
gcactgagtgattacagggc

SEQ ID NO: 351 - DNA, 20 bp, Artificial Sequence
  source: /note="Description of Artificial Sequence: Synthetic oligonucleotide"
ccttatgcacccaatccttg

SEQ ID NO: 352 - DNA, 20 bp, Artificial Sequence
  source: /note="Description of Artificial Sequence: Synthetic oligonucleotide"
tttcaggactttgcctcttt

SEQ ID NO: 353 - DNA, 20 bp, Artificial Sequence
  source: /note="Description of Artificial Sequence: Synthetic oligonucleotide"
cttagtgccattggtagagt

SEQ ID NO: 354 - DNA, 20 bp, Artificial Sequence
  source: /note="Description of Artificial Sequence: Synthetic oligonucleotide"
aagaagagcccaggttgtct

SEQ ID NO: 355 - DNA, 20 bp, Artificial Sequence
  source: /note="Description of Artificial Sequence: Synthetic oligonucleotide"
ttatgcacccaatccttgca

SEQ ID NO: 356 - DNA, 20 bp, Artificial Sequence
  source: /note="Description of Artificial Sequence: Synthetic oligonucleotide"
ctggccaagacagactctgg

SEQ ID NO: 357 - DNA, 20 bp, Artificial Sequence
  source: /note="Description of Artificial Sequence: Synthetic oligonucleotide"
ttgctcagaatacagtgccc

SEQ ID NO: 358 - DNA, 20 bp, Artificial Sequence
  source: /note="Description of Artificial Sequence: Synthetic oligonucleotide"
tatgcacccaatccttgcag

SEQ ID NO: 359 - DNA, 20 bp, Artificial Sequence
  source: /note="Description of Artificial Sequence: Synthetic oligonucleotide"
tgtctccagaactgagcagg

SEQ ID NO: 360 - DNA, 20 bp, Artificial Sequence
  source: /note="Description of Artificial Sequence: Synthetic oligonucleotide"
ccagcaagtgcagcaaagct

SEQ ID NO: 361 - DNA, 20 bp, Artificial Sequence
  source: /note="Description of Artificial Sequence: Synthetic oligonucleotide"
ctccagaactgagcagggac

SEQ ID NO: 362 - DNA, 20 bp, Artificial Sequence
  source: /note="Description of Artificial Sequence: Synthetic oligonucleotide"
aaggagccccaaacctggag

SEQ ID NO: 363 - DNA, 20 bp, Artificial Sequence
  source: /note="Description of Artificial Sequence: Synthetic oligonucleotide"
aggaaggagccccaaacctg

SEQ ID NO: 364 - DNA, 20 bp, Artificial Sequence
  source: /note="Description of Artificial Sequence: Synthetic oligonucleotide"
acaatctccttatgcaccca

SEQ ID NO: 365 - DNA, 20 bp, Artificial Sequence
  source: /note="Description of Artificial Sequence: Synthetic oligonucleotide"
cacaatctccttatgcaccc

SEQ ID NO: 366 - DNA, 20 bp, Artificial Sequence
  source: /note="Description of Artificial Sequence: Synthetic oligonucleotide"
agaagggtaccaggcaaggg

SEQ ID NO: 367 - DNA, 20 bp, Artificial Sequence
  source: /note="Description of Artificial Sequence: Synthetic oligonucleotide"
ccaagacagactctggcagg

SEQ ID NO: 368 - DNA, 20 bp, Artificial Sequence
  source: /note="Description of Artificial Sequence: Synthetic oligonucleotide"
ctcagaatacagtgcccagg

SEQ ID NO: 369 - DNA, 20 bp, Artificial Sequence
  source: /note="Description of Artificial Sequence: Synthetic oligonucleotide"
atctccttatgcacccaatc

SEQ ID NO: 370 - DNA, 20 bp, Artificial Sequence
  source: /note="Description of Artificial Sequence: Synthetic oligonucleotide"
gcaccagcaagtgcagcaaa

SEQ ID NO: 371 - DNA, 20 bp, Artificial Sequence
  source: /note="Description of Artificial Sequence: Synthetic oligonucleotide"
ctccaaactggtgtcagagc

SEQ ID NO: 372 - DNA, 20 bp, Artificial Sequence
  source: /note="Description of Artificial Sequence: Synthetic oligonucleotide"
caagtgcagcaaagctggct

SEQ ID NO: 373 - DNA, 20 bp, Artificial Sequence
  source: /note="Description of Artificial Sequence: Synthetic oligonucleotide"
aaggaagtcagagggagggc

SEQ ID NO: 374 - DNA, 20 bp, Artificial Sequence
  source: /note="Description of Artificial Sequence: Synthetic oligonucleotide"
cttaattcctgtctgaggct

SEQ ID NO: 375 - DNA, 20 bp, Artificial Sequence
  source: /note="Description of Artificial Sequence: Synthetic oligonucleotide"
tgattacagggcaaggccac

SEQ ID NO: 376 - DNA, 20 bp, Artificial Sequence
  source: /note="Description of Artificial Sequence: Synthetic oligonucleotide"
gctttagagatttgctaccc

SEQ ID NO: 377 - DNA, 20 bp, Artificial Sequence
  source: /note="Description of Artificial Sequence: Synthetic oligonucleotide"
ccagcttctccacatcaatg

SEQ ID NO: 378 - DNA, 20 bp, Artificial Sequence
  source: /note="Description of Artificial Sequence: Synthetic oligonucleotide"
ccagcctcagaatgattctc

SEQ ID NO: 379 - DNA, 20 bp, Artificial Sequence
  source: /note="Description of Artificial Sequence: Synthetic oligonucleotide"
cctccaaactggtgtcagag

SEQ ID NO: 380 - DNA, 20 bp, Artificial Sequence
  source: /note="Description of Artificial Sequence: Synthetic oligonucleotide"
ggcactgagtgattacaggg

SEQ ID NO: 381 - DNA, 20 bp, Artificial Sequence
  source: /note="Description of Artificial Sequence: Synthetic oligonucleotide"
gggcactgagtgattacagg

SEQ ID NO: 382 - DNA, 20 bp, Artificial Sequence
  source: /note="Description of Artificial Sequence: Synthetic oligonucleotide"
ttggcaaaggtgatgcaggc

SEQ ID NO: 383 - DNA, 20 bp, Artificial Sequence
  source: /note="Description of Artificial Sequence: Synthetic oligonucleotide"
aagacagactctggcaggga

SEQ ID NO: 384 - DNA, 20 bp, Artificial Sequence
  source: /note="Description of Artificial Sequence: Synthetic oligonucleotide"
accagcaagtgcagcaaagc

SEQ ID NO: 385 - DNA, 20 bp, Artificial Sequence
  source: /note="Description of Artificial Sequence: Synthetic oligonucleotide"
gccctggatgtggcaaaaga

SEQ ID NO: 386 - DNA, 20 bp, Artificial Sequence
  source: /note="Description of Artificial Sequence: Synthetic oligonucleotide"
gagtgattacagggcaaggc

SEQ ID NO: 387 - DNA, 20 bp, Artificial Sequence
  source: /note="Description of Artificial Sequence: Synthetic oligonucleotide"
gacttagtgccattggtaga

SEQ ID NO: 388 - DNA, 20 bp, Artificial Sequence
  source: /note="Description of Artificial Sequence: Synthetic oligonucleotide"
caagacagactctggcaggg

SEQ ID NO: 389 - DNA, 20 bp, Artificial Sequence
  source: /note="Description of Artificial Sequence: Synthetic oligonucleotide"
acccatgacactctggatga

SEQ ID NO: 390 - DNA, 20 bp, Artificial Sequence
  source: /note="Description of Artificial Sequence: Synthetic oligonucleotide"
gagaagggtaccaggcaagg

SEQ ID NO: 391 - DNA, 20 bp, Artificial Sequence
  source: /note="Description of Artificial Sequence: Synthetic oligonucleotide"
cacccatgacactctggatg

SEQ ID NO: 392 - DNA, 20 bp, Artificial Sequence
  source: /note="Description of Artificial Sequence: Synthetic oligonucleotide"
cattgccttaattcctgtct

SEQ ID NO: 393 - DNA, 20 bp, Artificial Sequence
  source: /note="Description of Artificial Sequence: Synthetic oligonucleotide"
cttgctcagaatacagtgcc

SEQ ID NO: 394 - DNA, 20 bp, Artificial Sequence
  source: /note="Description of Artificial Sequence: Synthetic oligonucleotide"
ccttgctcagaatacagtgc

SEQ ID NO: 395 - DNA, 20 bp, Artificial Sequence
  source: /note="Description of Artificial Sequence: Synthetic oligonucleotide"
cccatgacactctggatgag

SEQ ID NO: 396 - DNA, 20 bp, Artificial Sequence
  source: /note="Description of Artificial Sequence: Synthetic oligonucleotide"
actggccaagacagactctg

SEQ ID NO: 397 - DNA, 20 bp, Artificial Sequence
  source: /note="Description of Artificial Sequence: Synthetic oligonucleotide"
aagtgcagcaaagctggctg

SEQ ID NO: 398 - DNA, 20 bp, Artificial Sequence
  source: /note="Description of Artificial Sequence: Synthetic oligonucleotide"
cagacaacccaatggcaggg

SEQ ID NO: 399 - DNA, 20 bp, Artificial Sequence
  source: /note="Description of Artificial Sequence: Synthetic oligonucleotide"
aaggaaggagccccaaacct

SEQ ID NO: 400 - DNA, 20 bp, Artificial Sequence
  source: /note="Description of Artificial Sequence: Synthetic oligonucleotide"
gcctcagaatgattctcagg

SEQ ID NO: 401 - DNA, 20 bp, Artificial Sequence
  source: /note="Description of Artificial Sequence: Synthetic oligonucleotide"
cccttgctcagaatacagtg

SEQ ID NO: 402 - DNA, 20 bp, Artificial Sequence
  source: /note="Description of Artificial Sequence: Synthetic oligonucleotide"
caaactggtgtcagagcctg

SEQ ID NO: 403 - DNA, 20 bp, Artificial Sequence
  source: /note="Description of Artificial Sequence: Synthetic oligonucleotide"
gttggcaaaggtgatgcagg

SEQ ID NO: 404 - DNA, 20 bp, Artificial Sequence
  source: /note="Description of Artificial Sequence: Synthetic oligonucleotide"
ggttggcaaaggtgatgcag

SEQ ID NO: 405 - DNA, 20 bp, Artificial Sequence
  source: /note="Description of Artificial Sequence: Synthetic oligonucleotide"
taagaagagcccaggttgtc

SEQ ID NO: 406 - DNA, 20 bp, Artificial Sequence
  source: /note="Description of Artificial Sequence: Synthetic oligonucleotide"
tcacaatctccttatgcacc

SEQ ID NO: 407 - DNA, 20 bp, Artificial Sequence
  source: /note="Description of Artificial Sequence: Synthetic oligonucleotide"
cctctccagatactgaggaa

SEQ ID NO: 408 - DNA, 20 bp, Artificial Sequence
  source: /note="Description of Artificial Sequence: Synthetic oligonucleotide"
agcaagtgcagcaaagctgg

SEQ ID NO: 409 - DNA, 20 bp, Artificial Sequence
  source: /note="Description of Artificial Sequence: Synthetic oligonucleotide"
ttagtgccattggtagagta

SEQ ID NO: 410 - DNA, 20 bp, Artificial Sequence
  source: /note="Description of Artificial Sequence: Synthetic oligonucleotide"
acttagtgccattggtagag

SEQ ID NO: 411 - DNA, 20 bp, Artificial Sequence
  source: /note="Description of Artificial Sequence: Synthetic oligonucleotide"
tagtgccattggtagagtag

SEQ ID NO: 412 - DNA, 20 bp, Artificial Sequence
  source: /note="Description of Artificial Sequence: Synthetic oligonucleotide"
gaaggaaggagccccaaacc

SEQ ID NO: 413 - DNA, 20 bp, Artificial Sequence
  source: /note="Description of Artificial Sequence: Synthetic oligonucleotide"
ggtagagtaggaaaccaggc

SEQ ID NO: 414 - DNA, 20 bp, Artificial Sequence
  source: /note="Description of Artificial Sequence: Synthetic oligonucleotide"
cactgagtgattacagggca

SEQ ID NO: 415 - DNA, 20 bp, Artificial Sequence
  source: /note="Description of Artificial Sequence: Synthetic oligonucleotide"
gagagaagggtaccaggcaa

SEQ ID NO: 416 - DNA, 20 bp, Artificial Sequence
  source: /note="Description of Artificial Sequence: Synthetic oligonucleotide"
caatctccttatgcacccaa

SEQ ID NO: 417 - DNA, 20 bp, Artificial Sequence
  source: /note="Description of Artificial Sequence: Synthetic oligonucleotide"
gctgttccttcagaaaggac

SEQ ID NO: 418 - DNA, 20 bp, Artificial Sequence
  source: /note="Description of Artificial Sequence: Synthetic oligonucleotide"
gtcacaatctccttatgcac

SEQ ID NO: 419 - DNA, 20 bp, Artificial Sequence
  source: /note="Description of Artificial Sequence: Synthetic oligonucleotide"
tttgccttttcaggactttg

SEQ ID NO: 420 - DNA, 20 bp, Artificial Sequence
  source: /note="Description of Artificial Sequence: Synthetic oligonucleotide"
acactctggatgagtttgtc

SEQ ID NO: 421 - DNA, 20 bp, Artificial Sequence
  source: /note="Description of Artificial Sequence: Synthetic oligonucleotide"
agctgttccttcagaaagga

SEQ ID NO: 422 - DNA, 20 bp, Artificial Sequence
  source: /note="Description of Artificial Sequence: Synthetic oligonucleotide"
ctttagagatttgctaccct

SEQ ID NO: 423 - DNA, 20 bp, Artificial Sequence
  source: /note="Description of Artificial Sequence: Synthetic oligonucleotide"
cagcttctccacatcaatga

SEQ ID NO: 424 - DNA, 20 bp, Artificial Sequence
  source: /note="Description of Artificial Sequence: Synthetic oligonucleotide"
gacactctggatgagtttgt

SEQ ID NO: 425 - DNA, 20 bp, Artificial Sequence
  source: /note="Description of Artificial Sequence: Synthetic oligonucleotide"
aagtaagcacagcctgcatg

SEQ ID NO: 426 - DNA, 20 bp, Artificial Sequence
  source: /note="Description of Artificial Sequence: Synthetic oligonucleotide"
cagcctcagaatgattctca

SEQ ID NO: 427 - DNA, 20 bp, Artificial Sequence
  source: /note="Description of Artificial Sequence: Synthetic oligonucleotide"
ggaaggaaggagccccaaac

SEQ ID NO: 428 - DNA, 20 bp, Artificial Sequence
  source: /note="Description of Artificial Sequence: Synthetic oligonucleotide"
agggcactgagtgattacag

SEQ ID NO: 429 - DNA, 20 bp, Artificial Sequence
  source: /note="Description of Artificial Sequence: Synthetic oligonucleotide"
tgccattggtagagtaggaa

SEQ ID NO: 430 - DNA, 20 bp, Artificial Sequence
  source: /note="Description of Artificial Sequence: Synthetic oligonucleotide"
caaggaagtcagagggaggg

SEQ ID NO: 431 - DNA, 20 bp, Artificial Sequence
  source: /note="Description of Artificial Sequence: Synthetic oligonucleotide"
agagaagggtaccaggcaag

SEQ ID NO: 432 - DNA, 20 bp, Artificial Sequence
  source: /note="Description of Artificial Sequence: Synthetic oligonucleotide"
acagacaacccaatggcagg

SEQ ID NO: 433 - DNA, 20 bp, Artificial Sequence
  source: /note="Description of Artificial Sequence: Synthetic oligonucleotide"
aagggaatgcagaaccaccc

SEQ ID NO: 434 - DNA, 20 bp, Artificial Sequence
  source: /note="Description of Artificial Sequence: Synthetic oligonucleotide"
aatctccttatgcacccaat

SEQ ID NO: 435 - DNA, 20 bp, Artificial Sequence
  source: /note="Description of Artificial Sequence: Synthetic oligonucleotide"
gcaggaagttgtaagtgcag

SEQ ID NO: 436 - DNA, 20 bp, Artificial Sequence
  source: /note="Description of Artificial Sequence: Synthetic oligonucleotide"
aggaagttgtaagtgcaggg

SEQ ID NO: 437 - DNA, 20 bp, Artificial Sequence
  source: /note="Description of Artificial Sequence: Synthetic oligonucleotide"
agcctcagaatgattctcag

SEQ ID NO: 438 - DNA, 20 bp, Artificial Sequence
  source: /note="Description of Artificial Sequence: Synthetic oligonucleotide"
tttagagatttgctaccctt

SEQ ID NO: 439 - DNA, 20 bp, Artificial Sequence
  source: /note="Description of Artificial Sequence: Synthetic oligonucleotide"
tgctttagagatttgctacc

SEQ ID NO: 440 - DNA, 20 bp, Artificial Sequence
  source: /note="Description of Artificial Sequence: Synthetic oligonucleotide"
gagacagacaacccaatggc

SEQ ID NO: 441 - DNA, 20 bp, Artificial Sequence
  source: /note="Description of Artificial Sequence: Synthetic oligonucleotide"
gacagacaacccaatggcag

SEQ ID NO: 442 - DNA, 20 bp, Artificial Sequence
  source: /note="Description of Artificial Sequence: Synthetic oligonucleotide"
agacagacaacccaatggca

SEQ ID NO: 443 - DNA, 20 bp, Artificial Sequence
  source: /note="Description of Artificial Sequence: Synthetic oligonucleotide"
aaagtaagcacagcctgcat

SEQ ID NO: 444 - DNA, 20 bp, Artificial Sequence
  source: /note="Description of Artificial Sequence: Synthetic oligonucleotide"
catgacactctggatgagtt

SEQ ID NO: 445 - DNA, 20 bp, Artificial Sequence
  source: /note="Description of Artificial Sequence: Synthetic oligonucleotide"
tgagtgattacagggcaagg

SEQ ID NO: 446 - DNA, 20 bp, Artificial Sequence
  source: /note="Description of Artificial Sequence: Synthetic oligonucleotide"
gccattggtagagtaggaaa

SEQ ID NO: 447 - DNA, 20 bp, Artificial Sequence
  source: /note="Description of Artificial Sequence: Synthetic oligonucleotide"
caggaagttgtaagtgcagg

SEQ ID NO: 448 - DNA, 20 bp, Artificial Sequence
  source: /note="Description of Artificial Sequence: Synthetic oligonucleotide"
actgagtgattacagggcaa

SEQ ID NO: 449 - DNA, 20 bp, Artificial Sequence
  source: /note="Description of Artificial Sequence: Synthetic oligonucleotide"
ggtagctgatgaagacatct

SEQ ID NO: 450 - DNA, 20 bp, Artificial Sequence
  source: /note="Description of Artificial Sequence: Synthetic oligonucleotide"
gaagggaatgcagaaccacc

SEQ ID NO: 451 - DNA, 20 bp, Artificial Sequence
  source: /note="Description of Artificial Sequence: Synthetic oligonucleotide"
gcttctccacatcaatgaag

SEQ ID NO: 452 - DNA, 20 bp, Artificial Sequence
  source: /note="Description of Artificial Sequence: Synthetic oligonucleotide"
agcttctccacatcaatgaa

SEQ ID NO: 453 - DNA, 20 bp, Artificial Sequence
  source: /note="Description of Artificial Sequence: Synthetic oligonucleotide"
atgacactctggatgagttt

SEQ ID NO: 454 - DNA, 20 bp, Artificial Sequence
  source: /note="Description of Artificial Sequence: Synthetic oligonucleotide"
tgacactctggatgagtttg

SEQ ID NO: 455 - DNA, 20 bp, Artificial Sequence
  source: /note="Description of Artificial Sequence: Synthetic oligonucleotide"
tggtagagtaggaaaccagg

SEQ ID NO: 456 - DNA, 20 bp, Artificial Sequence
  source: /note="Description of Artificial Sequence: Synthetic oligonucleotide"
ttttgggaaaagagggaccc

SEQ ID NO: 457 - DNA, 20 bp, Artificial Sequence
  source: /note="Description of Artificial Sequence: Synthetic oligonucleotide"
gttttgggaaaagagggacc

SEQ ID NO: 458 - DNA, 20 bp, Artificial Sequence
  source: /note="Description of Artificial Sequence: Synthetic oligonucleotide"
ctctccagatactgaggaaa

SEQ ID NO: 459 - DNA, 20 bp, Artificial Sequence
  source: /note="Description of Artificial Sequence: Synthetic oligonucleotide"
ctccagatactgaggaaagt

SEQ ID NO: 460 - DNA, 20 bp, Artificial Sequence
  source: /note="Description of Artificial Sequence: Synthetic oligonucleotide"
gcttaaagcagtcacaatct

SEQ ID NO: 461 - DNA, 20 bp, Artificial Sequence
  source: /note="Description of Artificial Sequence: Synthetic oligonucleotide"
gtagctgatgaagacatctg

SEQ ID NO: 462 - DNA, 20 bp, Artificial Sequence
  source: /note="Description of Artificial Sequence: Synthetic oligonucleotide"
ggttttgggaaaagagggac

SEQ ID NO: 463 - DNA, 20 bp, Artificial Sequence
  source: /note="Description of Artificial Sequence: Synthetic oligonucleotide"
ttgaaagtaagcacagcctg

SEQ ID NO: 464 - DNA, 20 bp, Artificial Sequence
  source: /note="Description of Artificial Sequence: Synthetic oligonucleotide"
ccagatactgaggaaagtgg

SEQ ID NO: 465 - DNA, 20 bp, Artificial Sequence
  source: /note="Description of Artificial Sequence: Synthetic oligonucleotide"
ttggtagagtaggaaaccag

SEQ ID NO: 466 - DNA, 20 bp, Artificial Sequence
  source: /note="Description of Artificial Sequence: Synthetic oligonucleotide"
cctggatgtggcaaaagata

SEQ ID NO: 467 - DNA, 20 bp, Artificial Sequence
  source: /note="Description of Artificial Sequence: Synthetic oligonucleotide"
ggatgtggcaaaagatacca

SEQ ID NO: 468 - DNA, 20 bp, Artificial Sequence
  source: /note="Description of Artificial Sequence: Synthetic oligonucleotide"
tagctgatgaagacatctgg

SEQ ID NO: 469 - DNA, 20 bp, Artificial Sequence
  source: /note="Description of Artificial Sequence: Synthetic oligonucleotide"
attggtagagtaggaaacca

SEQ ID NO: 470 - DNA, 20 bp, Artificial Sequence
  source: /note="Description of Artificial Sequence: Synthetic oligonucleotide"
cattggtagagtaggaaacc

SEQ ID NO: 471 - DNA, 20 bp, Artificial Sequence
  source: /note="Description of Artificial Sequence: Synthetic oligonucleotide"
ccattggtagagtaggaaac

SEQ ID NO: 472 - DNA, 20 bp, Artificial Sequence
  source: /note="Description of Artificial Sequence: Synthetic oligonucleotide"
tctccacatcaatgaagaca

SEQ ID NO: 473 - DNA, 20 bp, Artificial Sequence
  source: /note="Description of Artificial Sequence: Synthetic oligonucleotide"
tctccagatactgaggaaag

SEQ ID NO: 474 - DNA, 20 bp, Artificial Sequence
  source: /note="Description of Artificial Sequence: Synthetic oligonucleotide"
agcttaaagcagtcacaatc

SEQ ID NO: 475 - DNA, 20 bp, Artificial Sequence
  source: /note="Description of Artificial Sequence: Synthetic oligonucleotide"
cagcttaaagcagtcacaat

SEQ ID NO: 476 - DNA, 20 bp, Artificial Sequence
  source: /note="Description of Artificial Sequence: Synthetic oligonucleotide"
tccagatactgaggaaagtg

SEQ ID NO: 477 - DNA, 20 bp, Artificial Sequence
  source: /note="Description of Artificial Sequence: Synthetic oligonucleotide"
cagatactgaggaaagtggg

SEQ ID NO: 478 - DNA, 20 bp, Artificial Sequence
  source: /note="Description of Artificial Sequence: Synthetic oligonucleotide"
tggatgtggcaaaagatacc

SEQ ID NO: 479 - DNA, 20 bp, Artificial Sequence
  source: /note="Description of Artificial Sequence: Synthetic oligonucleotide"
tccacatcaatgaagacact

SEQ ID NO: 480 - DNA, 20 bp, Artificial Sequence
  source: /note="Description of Artificial Sequence: Synthetic oligonucleotide"
ctccacatcaatgaagacac

SEQ ID NO: 481 - DNA, 20 bp, Artificial Sequence
  source: /note="Description of Artificial Sequence: Synthetic oligonucleotide"
ttctccacatcaatgaagac

SEQ ID NO: 482 - DNA, 20 bp, Artificial Sequence
  source: /note="Description of Artificial Sequence: Synthetic oligonucleotide"
tgtggcaaaagataccacac

SEQ ID NO: 483 - DNA, 20 bp, Artificial Sequence
  source: /note="Description of Artificial Sequence: Synthetic oligonucleotide"
gatgtggcaaaagataccac

SEQ ID NO: 484 - DNA, 20 bp, Artificial Sequence
  source: /note="Description of Artificial Sequence: Synthetic oligonucleotide"
atgtggcaaaagataccaca

SEQ ID NO: 485 - DNA, 20 bp, Artificial Sequence
  source: /note="Description of Artificial Sequence: Synthetic oligonucleotide"
tctttgaagcaagggagaag

SEQ ID NO: 486 - DNA, 20 bp, Artificial Sequence
  source: /note="Description of Artificial Sequence: Synthetic oligonucleotide"
ccacatcaatgaagacactg

SEQ ID NO: 487 - DNA, 20 bp, Artificial Sequence
  source: /note="Description of Artificial Sequence: Synthetic oligonucleotide"
cacatcaatgaagacactga

SEQ ID NO: 488 - DNA, 20 bp, Artificial Sequence
  source: /note="Description of Artificial Sequence: Synthetic oligonucleotide"
acatcaatgaagacactgaa

SEQ ID NO: 489 - DNA, 20 bp, Artificial Sequence
  source: /note="Description of Artificial Sequence: Synthetic oligonucleotide"
agccatcaatgatgggcaca

SEQ ID NO: 490 - DNA, 20 bp, Artificial Sequence
  source: /note="Description of Artificial Sequence: Synthetic oligonucleotide"
gatgggcacaatgttcttgc

SEQ ID NO: 491 - DNA, 20 bp, Artificial Sequence
  source: /note="Description of Artificial Sequence: Synthetic oligonucleotide"
gccatcaatgatgggcacaa

SEQ ID NO: 492 - DNA, 20 bp, Artificial Sequence
  source: /note="Description of Artificial Sequence: Synthetic oligonucleotide"
atgatgggcacaatgttctt

SEQ ID NO: 493 - DNA, 20 bp, Artificial Sequence
  source: /note="Description of Artificial Sequence: Synthetic oligonucleotide"
tgatgggcacaatgttcttg

SEQ ID NO: 494 - DNA, 20 bp, Artificial Sequence
  source: /note="Description of Artificial Sequence: Synthetic oligonucleotide"
ccatcaatgatgggcacaat

SEQ ID NO: 495 - DNA, 20 bp, Artificial Sequence
  source: /note="Description of Artificial Sequence: Synthetic oligonucleotide"
aatgatgggcacaatgttct

SEQ ID NO: 496 - DNA, 20 bp, Artificial Sequence
  source: /note="Description of Artificial Sequence: Synthetic oligonucleotide"
caatgatgggcacaatgttc

SEQ ID NO: 497 - DNA, 20 bp, Artificial Sequence
  source: /note="Description of Artificial Sequence: Synthetic oligonucleotide"
tcaatgatgggcacaatgtt

SEQ ID NO: 498 - DNA, 20 bp, Artificial Sequence
  source: /note="Description of Artificial Sequence: Synthetic oligonucleotide"
atcaatgatgggcacaatgt

SEQ ID NO: 499 - DNA, 20 bp, Artificial Sequence
  source: /note="Description of Artificial Sequence: Synthetic oligonucleotide"
catcaatgatgggcacaatg

SEQ ID NO: 500 - DNA, 20 bp, Artificial Sequence
  source: /note="Description of Artificial Sequence: Synthetic oligonucleotide"
atgggcacaatgttcttgcc

SEQ ID NO: 501 - DNA, 20 bp, Artificial Sequence
  source: /note="Description of Artificial Sequence: Synthetic oligonucleotide"
ctcaatggtggcctcctggt

SEQ ID NO: 502 - DNA, 20 bp, Artificial Sequence
  source: /note="Description of Artificial Sequence: Synthetic oligonucleotide"
atggtggcctcctggtattc

SEQ ID NO: 503 - DNA, 20 bp, Artificial Sequence
  source: /note="Description of Artificial Sequence: Synthetic oligonucleotide"
tcaatggtggcctcctggta

SEQ ID NO: 504 - DNA, 20 bp, Artificial Sequence
  source: /note="Description of Artificial Sequence: Synthetic oligonucleotide"
caccttcaggagactggcca

SEQ ID NO: 505 - DNA, 20 bp, Artificial Sequence
  source: /note="Description of Artificial Sequence: Synthetic oligonucleotide"
tgcaccttcaggagactggc

SEQ ID NO: 506 - DNA, 20 bp, Artificial Sequence
  source: /note="Description of Artificial Sequence: Synthetic oligonucleotide"
gtgcaccttcaggagactgg

SEQ ID NO: 507 - DNA, 20 bp, Artificial Sequence
  source: /note="Description of Artificial Sequence: Synthetic oligonucleotide"
gaagccatcaatgatgggca

SEQ ID NO: 508 - DNA, 20 bp, Artificial Sequence
  source: /note="Description of Artificial Sequence: Synthetic oligonucleotide"
acatctggagtgtccccact

SEQ ID NO: 509 - DNA, 20 bp, Artificial Sequence
  source: /note="Description of Artificial Sequence: Synthetic oligonucleotide"
ccttgcagtcatggtcttgc

SEQ ID NO: 510 - DNA, 20 bp, Artificial Sequence
  source: /note="Description of Artificial Sequence: Synthetic oligonucleotide"
gacatctggagtgtccccac

SEQ ID NO: 511 - DNA, 20 bp, Artificial Sequence
  source: /note="Description of Artificial Sequence: Synthetic oligonucleotide"
catctggagtgtccccactg

SEQ ID NO: 512 - DNA, 20 bp, Artificial Sequence
  source: /note="Description of Artificial Sequence: Synthetic oligonucleotide"
agacatctggagtgtcccca

SEQ ID NO: 513 - DNA, 20 bp, Artificial Sequence
  source: /note="Description of Artificial Sequence: Synthetic oligonucleotide"
gcagtcatggtcttgcatgc

SEQ ID NO: 514 - DNA, 20 bp, Artificial Sequence
  source: /note="Description of Artificial Sequence: Synthetic oligonucleotide"
tccttgcagtcatggtcttg

SEQ ID NO: 515 - DNA, 20 bp, Artificial Sequence
  source: /note="Description of Artificial Sequence: Synthetic oligonucleotide"
aagacatctggagtgtcccc

SEQ ID NO: 516 - DNA, 20 bp, Artificial Sequence
  source: /note="Description of Artificial Sequence: Synthetic oligonucleotide"
gctgaacaccttggtcttgc

SEQ ID NO: 517 - DNA, 20 bp, Artificial Sequence
  source: /note="Description of Artificial Sequence: Synthetic oligonucleotide"
ctgaacaccttggtcttgcc

SEQ ID NO: 518 - DNA, 20 bp, Artificial Sequence
  source: /note="Description of Artificial Sequence: Synthetic oligonucleotide"
atgatcttctcaatggtggc

SEQ ID NO: 519 - DNA, 20 bp, Artificial Sequence
  source: /note="Description of Artificial Sequence: Synthetic oligonucleotide"
gatgatcttctcaatggtgg

SEQ ID NO: 520 - DNA, 20 bp, Artificial Sequence
  source: /note="Description of Artificial Sequence: Synthetic oligonucleotide"
ggatgatcttctcaatggtg

SEQ ID NO: 521 - DNA, 20 bp, Artificial Sequence
  source: /note="Description of Artificial Sequence: Synthetic oligonucleotide"
gcagcttaaagcagtcacaa

SEQ ID NO: 522 - DNA, 20 bp, Artificial Sequence
  source: /note="Description of Artificial Sequence: Synthetic oligonucleotide"
tctggagtgtccccactggg

SEQ ID NO: 523 - DNA, 20 bp, Artificial Sequence
  source: /note="Description of Artificial Sequence: Synthetic oligonucleotide"
atctggagtgtccccactgg

SEQ ID NO: 524 - DNA, 20 bp, Artificial Sequence
  source: /note="Description of Artificial Sequence: Synthetic oligonucleotide"
caatggtggcctcctggtat

SEQ ID NO: 525 - DNA, 20 bp, Artificial Sequence
  source: /note="Description of Artificial Sequence: Synthetic oligonucleotide"
aatggtggcctcctggtatt

SEQ ID NO: 526 - DNA, 20 bp, Artificial Sequence
  source: /note="Description of Artificial Sequence: Synthetic oligonucleotide"
ctgatgaagacatctggagt

SEQ ID NO: 527 - DNA, 20 bp, Artificial Sequence
  source: /note="Description of Artificial Sequence: Synthetic oligonucleotide"
atccttgcagtcatggtctt

SEQ ID NO: 528 - DNA, 20 bp, Artificial Sequence
  source: /note="Description of Artificial Sequence: Synthetic oligonucleotide"
gaacaccttggtcttgcctt

SEQ ID NO: 529 - DNA, 20 bp, Artificial Sequence
  source: /note="Description of Artificial Sequence: Synthetic oligonucleotide"
tgaacaccttggtcttgcct

SEQ ID NO: 530 - DNA, 20 bp, Artificial Sequence
  source: /note="Description of Artificial Sequence: Synthetic oligonucleotide"
aatccttgcagtcatggtct

SEQ ID NO: 531 - DNA, 20 bp, Artificial Sequence
  source: /note="Description of Artificial Sequence: Synthetic oligonucleotide"
aacaccttggtcttgccttg

SEQ ID NO: 532 - DNA, 20 bp, Artificial Sequence
  source: /note="Description of Artificial Sequence: Synthetic oligonucleotide"
gaagacatctggagtgtccc

SEQ ID NO: 533 - DNA, 20 bp, Artificial Sequence
  source: /note="Description of Artificial Sequence: Synthetic oligonucleotide"
tcagacactgtattgttatt

SEQ ID NO: 534 - DNA, 20 bp, Artificial Sequence
  source: /note="Description of Artificial Sequence: Synthetic oligonucleotide"
cagacactgtattgttattg

SEQ ID NO: 535 - DNA, 20 bp, Artificial Sequence
  source: /note="Description of Artificial Sequence: Synthetic oligonucleotide"
gacactgaagccatgcagct

SEQ ID NO: 536 - DNA, 20 bp, Artificial Sequence
  source: /note="Description of Artificial Sequence: Synthetic oligonucleotide"
acactgaagccatgcagctg

SEQ ID NO: 537 - DNA, 20 bp, Artificial Sequence
  source: /note="Description of Artificial Sequence: Synthetic oligonucleotide"
agacactgaagccatgcagc

SEQ ID NO: 538 - DNA, 20 bp, Artificial Sequence
  source: /note="Description of Artificial Sequence: Synthetic oligonucleotide"
ctctggatgagtttgtcctc

SEQ ID NO: 539 - DNA, 20 bp, Artificial Sequence
  source: /note="Description of Artificial Sequence: Synthetic oligonucleotide"
ctggagtgtccccactgggt

SEQ ID NO: 540 - DNA, 20 bp, Artificial Sequence
  source: /note="Description of Artificial Sequence: Synthetic oligonucleotide"
ggagtgtccccactgggttt

SEQ ID NO: 541 - DNA, 20 bp, Artificial Sequence
  source: /note="Description of Artificial Sequence: Synthetic oligonucleotide"
tggagtgtccccactgggtt

SEQ ID NO: 542 - DNA, 20 bp, Artificial Sequence
  source: /note="Description of Artificial Sequence: Synthetic oligonucleotide"
gagtgtccccactgggtttg

SEQ ID NO: 543 - DNA, 20 bp, Artificial Sequence
  source: /note="Description of Artificial Sequence: Synthetic oligonucleotide"
caccttggtcttgccttgca

SEQ ID NO: 544 - DNA, 20 bp, Artificial Sequence
  source: /note="Description of Artificial Sequence: Synthetic oligonucleotide"
acaccttggtcttgccttgc

SEQ ID NO: 545 - DNA, 20 bp, Artificial Sequence
  source: /note="Description of Artificial Sequence: Synthetic oligonucleotide"
ttgactttctgatgatgtgg

SEQ ID NO: 546 - DNA, 20 bp, Artificial Sequence
  source: /note="Description of Artificial Sequence: Synthetic oligonucleotide"
actctggatgagtttgtcct

SEQ ID NO: 547 - DNA, 20 bp, Artificial Sequence
  source: /note="Description of Artificial Sequence: Synthetic oligonucleotide"
cactctggatgagtttgtcc

SEQ ID NO: 548 - DNA, 20 bp, Artificial Sequence
  source: /note="Description of Artificial Sequence: Synthetic oligonucleotide"
gcaggttctgtctaggctgc

SEQ ID NO: 549 - DNA, 20 bp, Artificial Sequence
  source: /note="Description of Artificial Sequence: Synthetic oligonucleotide"
gctgcaggttctgtctaggc

SEQ ID NO: 550 - DNA, 20 bp, Artificial Sequence
  source: /note="Description of Artificial Sequence: Synthetic oligonucleotide"
caggttctgtctaggctgct

SEQ ID NO: 551 - DNA, 20 bp, Artificial Sequence
  source: /note="Description of Artificial Sequence: Synthetic oligonucleotide"
ctgcaggttctgtctaggct

SEQ ID NO: 552 - DNA, 20 bp, Artificial Sequence
  source: /note="Description of Artificial Sequence: Synthetic oligonucleotide"
tgcaggttctgtctaggctg

SEQ ID NO: 553 - DNA, 20 bp, Artificial Sequence
  source: /note="Description of Artificial Sequence: Synthetic oligonucleotide"
aacccaatggcagggcctgg

SEQ ID NO: 554 - DNA, 20 bp, Artificial Sequence
  source: /note="Description of Artificial Sequence: Synthetic oligonucleotide"
caacccaatggcagggcctg

SEQ ID NO: 555 - DNA, 20 bp, Artificial Sequence
  source: /note="Description of Artificial Sequence: Synthetic oligonucleotide"
gtgtctccagaactgagcag

SEQ ID NO: 556 - DNA, 20 bp, Artificial Sequence
  source: /note="Description of Artificial Sequence: Synthetic oligonucleotide"
gggctgcctggtccctgagt

SEQ ID NO: 557 - DNA, 20 bp, Artificial Sequence
  source: /note="Description of Artificial Sequence: Synthetic oligonucleotide"
ggctgcctggtccctgagta

SEQ ID NO: 558 - DNA, 20 bp, Artificial Sequence
  source: /note="Description of Artificial Sequence: Synthetic oligonucleotide"
gcctgacttcccttccctct

SEQ ID NO: 559 - DNA, 20 bp, Artificial Sequence
  source: /note="Description of Artificial Sequence: Synthetic oligonucleotide"
gtcctgtgagggcagtgtcc

SEQ ID NO: 560 - DNA, 20 bp, Artificial Sequence
  source: /note="Description of Artificial Sequence: Synthetic oligonucleotide"
actcatccctggctggctcc

SEQ ID NO: 561 - DNA, 20 bp, Artificial Sequence
  source: /note="Description of Artificial Sequence: Synthetic oligonucleotide"
gtgagggcagtgtccaggct

SEQ ID NO: 562 - DNA, 20 bp, Artificial Sequence
  source: /note="Description of Artificial Sequence: Synthetic oligonucleotide"
gtgggtagccctggatggct

SEQ ID NO: 563 - DNA, 20 bp, Artificial Sequence
  source: /note="Description of Artificial Sequence: Synthetic oligonucleotide"
gtatggcctctgggtcagct

SEQ ID NO: 564 - DNA, 20 bp, Artificial Sequence
  source: /note="Description of Artificial Sequence: Synthetic oligonucleotide"
agtgggttggaggtgggcca

SEQ ID NO: 565 - DNA, 20 bp, Artificial Sequence
  source: /note="Description of Artificial Sequence: Synthetic oligonucleotide"
gtgggttggaggtgggccat

SEQ ID NO: 566 - DNA, 20 bp, Artificial Sequence
  source: /note="Description of Artificial Sequence: Synthetic oligonucleotide"
tgtgagggcagtgtccaggc

SEQ ID NO: 567 - DNA, 20 bp, Artificial Sequence
  source: /note="Description of Artificial Sequence: Synthetic oligonucleotide"
gggtagccctggatggctga

SEQ ID NO: 568 - DNA, 20 bp, Artificial Sequence
  source: /note="Description of Artificial Sequence: Synthetic oligonucleotide"
ccccaactccagtgtctcca

SEQ ID NO: 569 - DNA, 20 bp, Artificial Sequence
  source: /note="Description of Artificial Sequence: Synthetic oligonucleotide"
gttgtctcagcccagggaga

SEQ ID NO: 570 - DNA, 20 bp, Artificial Sequence
  source: /note="Description of Artificial Sequence: Synthetic oligonucleotide"
ctgtcctgtgagggcagtgt

SEQ ID NO: 571 - DNA, 20 bp, Artificial Sequence
  source: /note="Description of Artificial Sequence: Synthetic oligonucleotide"
cccagatgcagggagtgggc

SEQ ID NO: 572 - DNA, 20 bp, Artificial Sequence
  source: /note="Description of Artificial Sequence: Synthetic oligonucleotide"
tgtcctgtgagggcagtgtc

SEQ ID NO: 573 - DNA, 20 bp, Artificial Sequence
  source: /note="Description of Artificial Sequence: Synthetic oligonucleotide"
cctgtgagggcagtgtccag

SEQ ID NO: 574 - DNA, 20 bp, Artificial Sequence
  source: /note="Description of Artificial Sequence: Synthetic oligonucleotide"
atggcctctgggtcagcttt

SEQ ID NO: 575 - DNA, 20 bp, Artificial Sequence
  source: /note="Description of Artificial Sequence: Synthetic oligonucleotide"
gctgcctggtccctgagtaa

SEQ ID NO: 576 - DNA, 20 bp, Artificial Sequence
  source: /note="Description of Artificial Sequence: Synthetic oligonucleotide"
tgcaggcccagatgcaggga

SEQ ID NO: 577 - DNA, 20 bp, Artificial Sequence
  source: /note="Description of Artificial Sequence: Synthetic oligonucleotide"
gggttggaggtgggccatga

SEQ ID NO: 578 - DNA, 20 bp, Artificial Sequence
  source: /note="Description of Artificial Sequence: Synthetic oligonucleotide"
ggctgccctgcttgtcatat

SEQ ID NO: 579 - DNA, 20 bp, Artificial Sequence
  source: /note="Description of Artificial Sequence: Synthetic oligonucleotide"
tgggtagccctggatggctg

SEQ ID NO: 580 - DNA, 20 bp, Artificial Sequence
  source: /note="Description of Artificial Sequence: Synthetic oligonucleotide"
ctgtgagggcagtgtccagg

SEQ ID NO: 581 - DNA, 20 bp, Artificial Sequence
  source: /note="Description of Artificial Sequence: Synthetic oligonucleotide"
aagcctgacttcccttccct

SEQ ID NO: 582 - DNA, 20 bp, Artificial Sequence
  source: /note="Description of Artificial Sequence: Synthetic oligonucleotide"
ggtgatgcaggcccagatgc

SEQ ID NO: 583 - DNA, 20 bp, Artificial Sequence
  source: /note="Description of Artificial Sequence: Synthetic oligonucleotide"
tatggcctctgggtcagctt

SEQ ID NO: 584 - DNA, 20 bp, Artificial Sequence
  source: /note="Description of Artificial Sequence: Synthetic oligonucleotide"
tgtccagtgctccaggtgat

SEQ ID NO: 585 - DNA, 20 bp, Artificial Sequence
  source: /note="Description of Artificial Sequence: Synthetic oligonucleotide"
gctgccctgcttgtcatatc

SEQ ID NO: 586 - DNA, 20 bp, Artificial Sequence
  source: /note="Description of Artificial Sequence: Synthetic oligonucleotide"
aagtgggttggaggtgggcc

SEQ ID NO: 587 - DNA, 20 bp, Artificial Sequence
  source: /note="Description of Artificial Sequence: Synthetic oligonucleotide"
gtagccctggatggctgagg

SEQ ID NO: 588 - DNA, 20 bp, Artificial Sequence
  source: /note="Description of Artificial Sequence: Synthetic oligonucleotide"
atgcaggcccagatgcaggg

SEQ ID NO: 589 - DNA, 20 bp, Artificial Sequence
  source: /note="Description of Artificial Sequence: Synthetic oligonucleotide"
gtccagtgctccaggtgata

SEQ ID NO: 590 - DNA, 20 bp, Artificial Sequence
  source: /note="Description of Artificial Sequence: Synthetic oligonucleotide"
caagcctgacttcccttccc

SEQ ID NO: 591 - DNA, 20 bp, Artificial Sequence
  source: /note="Description of Artificial Sequence: Synthetic oligonucleotide"
ccaagcctgacttcccttcc

SEQ ID NO: 592 - DNA, 20 bp, Artificial Sequence
  source: /note="Description of Artificial Sequence: Synthetic oligonucleotide"
tgcctggtccctgagtaagc

SEQ ID NO: 593 - DNA, 20 bp, Artificial Sequence
  source: /note="Description of Artificial Sequence: Synthetic oligonucleotide"
gcctggagcctgggtttatt

SEQ ID NO: 594 - DNA, 20 bp, Artificial Sequence
  source: /note="Description of Artificial Sequence: Synthetic oligonucleotide"
aggcccagatgcagggagtg

SEQ ID NO: 595 - DNA, 20 bp, Artificial Sequence
  source: /note="Description of Artificial Sequence: Synthetic oligonucleotide"
gtgctccaggtgatagcacc

SEQ ID NO: 596 - DNA, 20 bp, Artificial Sequence
  source: /note="Description of Artificial Sequence: Synthetic oligonucleotide"
tgggttggaggtgggccatg

SEQ ID NO: 597 - DNA, 20 bp, Artificial Sequence
  source: /note="Description of Artificial Sequence: Synthetic oligonucleotide"
ggttctgtctaggctgcttt

SEQ ID NO: 598 - DNA, 20 bp, Artificial Sequence
  source: /note="Description of Artificial Sequence: Synthetic oligonucleotide"
aggttctgtctaggctgctt

SEQ ID NO: 599 - DNA, 20 bp, Artificial Sequence
  source: /note="Description of Artificial Sequence: Synthetic oligonucleotide"
ctgccctgcttgtcatatcc

SEQ ID NO: 600 - DNA, 20 bp, Artificial Sequence
  source: /note="Description of Artificial Sequence: Synthetic oligonucleotide"
aagcagtgggtagccctgga

SEQ ID NO: 601 - DNA, 20 bp, Artificial Sequence
  source: /note="Description of Artificial Sequence: Synthetic oligonucleotide"
gtgatgcaggcccagatgca

SEQ ID NO: 602 - DNA, 20 bp, Artificial Sequence
  source: /note="Description of Artificial Sequence: Synthetic oligonucleotide"
ttgtctcagcccagggagac

SEQ ID NO: 603 - DNA, 20 bp, Artificial Sequence
  source: /note="Description of Artificial Sequence: Synthetic oligonucleotide"
cccaactccagtgtctccag

SEQ ID NO: 604 - DNA, 20 bp, Artificial Sequence
  source: /note="Description of Artificial Sequence: Synthetic oligonucleotide"
gttggaggtgggccatgagg

SEQ ID NO: 605 - DNA, 20 bp, Artificial Sequence
  source: /note="Description of Artificial Sequence: Synthetic oligonucleotide"
ggttggaggtgggccatgag

SEQ ID NO: 606 - DNA, 20 bp, Artificial Sequence
  source: /note="Description of Artificial Sequence: Synthetic oligonucleotide"
cagagctgcaggttctgtct

SEQ ID NO: 607 - DNA, 20 bp, Artificial Sequence
  source: /note="Description of Artificial Sequence: Synthetic oligonucleotide"
gatgcaggcccagatgcagg

SEQ ID NO: 608 - DNA, 20 bp, Artificial Sequence
  source: /note="Description of Artificial Sequence: Synthetic oligonucleotide"
gcttgtcatatccatgccct

SEQ ID NO: 609 - DNA, 20 bp, Artificial Sequence
  source: /note="Description of Artificial Sequence: Synthetic oligonucleotide"
gccctgcttgtcatatccat

SEQ ID NO: 610 - DNA, 20 bp, Artificial Sequence
  source: /note="Description of Artificial Sequence: Synthetic oligonucleotide"
ggctggcactggccaagaca

SEQ ID NO: 611 - DNA, 20 bp, Artificial Sequence
  source: /note="Description of Artificial Sequence: Synthetic oligonucleotide"
tgccctgcttgtcatatcca

SEQ ID NO: 612 - DNA, 20 bp, Artificial Sequence
  source: /note="Description of Artificial Sequence: Synthetic oligonucleotide"
agctgcaggttctgtctagg

SEQ ID NO: 613 - DNA, 20 bp, Artificial Sequence
  source: /note="Description of Artificial Sequence: Synthetic oligonucleotide"
ttggaggtgggccatgaggg

SEQ ID NO: 614 - DNA, 20 bp, Artificial Sequence
  source: /note="Description of Artificial Sequence: Synthetic oligonucleotide"
agaatacagtgcccaggccc

SEQ ID NO: 615 - DNA, 20 bp, Artificial Sequence
  source: /note="Description of Artificial Sequence: Synthetic oligonucleotide"
aggctggcactggccaagac

SEQ ID NO: 616 - DNA, 20 bp, Artificial Sequence
  source: /note="Description of Artificial Sequence: Synthetic oligonucleotide"
gtttcaggagctgttccttc

SEQ ID NO: 617 - DNA, 20 bp, Artificial Sequence
  source: /note="Description of Artificial Sequence: Synthetic oligonucleotide"
ctgcctggtccctgagtaag

SEQ ID NO: 618 - DNA, 20 bp, Artificial Sequence
  source: /note="Description of Artificial Sequence: Synthetic oligonucleotide"
tgctccaggtgatagcacca

SEQ ID NO: 619 - DNA, 20 bp, Artificial Sequence
  source: /note="Description of Artificial Sequence: Synthetic oligonucleotide"
ccctttgccttttcaggact

SEQ ID NO: 620 - DNA, 20 bp, Artificial Sequence
  source: /note="Description of Artificial Sequence: Synthetic oligonucleotide"
gcagccagctttaaggtgtc

SEQ ID NO: 621 - DNA, 20 bp, Artificial Sequence
  source: /note="Description of Artificial Sequence: Synthetic oligonucleotide"
ggcaaaggtgatgcaggccc

SEQ ID NO: 622 - DNA, 20 bp, Artificial Sequence
  source: /note="Description of Artificial Sequence: Synthetic oligonucleotide"
gttctgtctaggctgctttt

SEQ ID NO: 623 - DNA, 20 bp, Artificial Sequence
  source: /note="Description of Artificial Sequence: Synthetic oligonucleotide"
gagctgcaggttctgtctag

SEQ ID NO: 624 - DNA, 20 bp, Artificial Sequence
  source: /note="Description of Artificial Sequence: Synthetic oligonucleotide"
agagctgcaggttctgtcta

SEQ ID NO: 625 - DNA, 20 bp, Artificial Sequence
  source: /note="Description of Artificial Sequence: Synthetic oligonucleotide"
gtcaggctagctaagggcac

SEQ ID NO: 626 - DNA, 20 bp, Artificial Sequence
  source: /note="Description of Artificial Sequence: Synthetic oligonucleotide"
ccaactccagtgtctccaga

SEQ ID NO: 627 - DNA, 20 bp, Artificial Sequence
  source: /note="Description of Artificial Sequence: Synthetic oligonucleotide"
aggtgatgcaggcccagatg

SEQ ID NO: 628 - DNA, 20 bp, Artificial Sequence
  source: /note="Description of Artificial Sequence: Synthetic oligonucleotide"
tgcttgtcatatccatgccc

SEQ ID NO: 629 - DNA, 20 bp, Artificial Sequence
  source: /note="Description of Artificial Sequence: Synthetic oligonucleotide"
agtcaggctagctaagggca

SEQ ID NO: 630 - DNA, 20 bp, Artificial Sequence
  source: /note="Description of Artificial Sequence: Synthetic oligonucleotide"
gctggcactggccaagacag

SEQ ID NO: 631 - DNA, 20 bp, Artificial Sequence
  source: /note="Description of Artificial Sequence: Synthetic oligonucleotide"
agtgctccaggtgatagcac

SEQ ID NO: 632 - DNA, 20 bp, Artificial Sequence
  source: /note="Description of Artificial Sequence: Synthetic oligonucleotide"
tcaggagctgttccttcaga

SEQ ID NO: 633 - DNA, 20 bp, Artificial Sequence
  source: /note="Description of Artificial Sequence: Synthetic oligonucleotide"
tctaggctgcttttactgcc

SEQ ID NO: 634 - DNA, 20 bp, Artificial Sequence
  source: /note="Description of Artificial Sequence: Synthetic oligonucleotide"
tgatgcaggcccagatgcag

SEQ ID NO: 635 - DNA, 20 bp, Artificial Sequence
  source: /note="Description of Artificial Sequence: Synthetic oligonucleotide"
acaacccaatggcagggcct

SEQ ID NO: 636 - DNA, 20 bp, Artificial Sequence
  source: /note="Description of Artificial Sequence: Synthetic oligonucleotide"
accctttgccttttcaggac

SEQ ID NO: 637 - DNA, 20 bp, Artificial Sequence
  source: /note="Description of Artificial Sequence: Synthetic oligonucleotide"
accctctgaacccagtggag

SEQ ID NO: 638 - DNA, 20 bp, Artificial Sequence
  source: /note="Description of Artificial Sequence: Synthetic oligonucleotide"
gcaaaggtgatgcaggccca

SEQ ID NO: 639 - DNA, 20 bp, Artificial Sequence
  source: /note="Description of Artificial Sequence: Synthetic oligonucleotide"
gactggttaggttggaccca

SEQ ID NO: 640 - DNA, 20 bp, Artificial Sequence
  source: /note="Description of Artificial Sequence: Synthetic oligonucleotide"
gtctaggctgcttttactgc

SEQ ID NO: 641 - DNA, 20 bp, Artificial Sequence
  source: /note="Description of Artificial Sequence: Synthetic oligonucleotide"
acagtctgagtggagagcca

SEQ ID NO: 642 - DNA, 20 bp, Artificial Sequence
  source: /note="Description of Artificial Sequence: Synthetic oligonucleotide"
cacagtctgagtggagagcc

SEQ ID NO: 643 - DNA, 20 bp, Artificial Sequence
  source: /note="Description of Artificial Sequence: Synthetic oligonucleotide"
gacaacccaatggcagggcc

SEQ ID NO: 644 - DNA, 20 bp, Artificial Sequence
  source: /note="Description of Artificial Sequence: Synthetic oligonucleotide"
aggaagtcagagggagggct

SEQ ID NO: 645 - DNA, 20 bp, Artificial Sequence
  source: /note="Description of Artificial Sequence: Synthetic oligonucleotide"
tcaggctagctaagggcact

SEQ ID NO: 646 - DNA, 20 bp, Artificial Sequence
  source: /note="Description of Artificial Sequence: Synthetic oligonucleotide"
cctggagcctgggtttattg

SEQ ID NO: 647 - DNA, 20 bp, Artificial Sequence
  source: /note="Description of Artificial Sequence: Synthetic oligonucleotide"
tcttaccctctgaacccagt

SEQ ID NO: 648 - DNA, 20 bp, Artificial Sequence
  source: /note="Description of Artificial Sequence: Synthetic oligonucleotide"
gcacttgtgctgcatgagga

SEQ ID NO: 649 - DNA, 20 bp, Artificial Sequence
  source: /note="Description of Artificial Sequence: Synthetic oligonucleotide"
gggtttattggagggtgctt

SEQ ID NO: 650 - DNA, 20 bp, Artificial Sequence
  source: /note="Description of Artificial Sequence: Synthetic oligonucleotide"
ttcaggagctgttccttcag

SEQ ID NO: 651 - DNA, 20 bp, Artificial Sequence
  source: /note="Description of Artificial Sequence: Synthetic oligonucleotide"
taccctctgaacccagtgga

SEQ ID NO: 652 - DNA, 20 bp, Artificial Sequence
  source: /note="Description of Artificial Sequence: Synthetic oligonucleotide"
ggagagccatgatggcactc

SEQ ID NO: 653 - DNA, 20 bp, Artificial Sequence
  source: /note="Description of Artificial Sequence: Synthetic oligonucleotide"
ctgcttgtcatatccatgcc

SEQ ID NO: 654 - DNA, 20 bp, Artificial Sequence
  source: /note="Description of Artificial Sequence: Synthetic oligonucleotide"
cctgcttgtcatatccatgc

SEQ ID NO: 655 - DNA, 20 bp, Artificial Sequence
  source: /note="Description of Artificial Sequence: Synthetic oligonucleotide"
cagtctgagtggagagccat

SEQ ID NO: 656 - DNA, 20 bp, Artificial Sequence
  source: /note="Description of Artificial Sequence: Synthetic oligonucleotide"
atctgggacttagtcaggct

SEQ ID NO: 657 - DNA, 20 bp, Artificial Sequence
  source: /note="Description of Artificial Sequence: Synthetic oligonucleotide"
tagtcaggctagctaagggc

SEQ ID NO: 658 - DNA, 20 bp, Artificial Sequence
  source: /note="Description of Artificial Sequence: Synthetic oligonucleotide"
gtggagagccatgatggcac

SEQ ID NO: 659 - DNA, 20 bp, Artificial Sequence
  source: /note="Description of Artificial Sequence: Synthetic oligonucleotide"
gtctgagtggagagccatga

SEQ ID NO: 660 - DNA, 20 bp, Artificial Sequence
  source: /note="Description of Artificial Sequence: Synthetic oligonucleotide"
gagtggagagccatgatggc

SEQ ID NO: 661 - DNA, 20 bp, Artificial Sequence
  source: /note="Description of Artificial Sequence: Synthetic oligonucleotide"
tgggtttattggagggtgct

SEQ ID NO: 662 - DNA, 20 bp, Artificial Sequence
  source: /note="Description of Artificial Sequence: Synthetic oligonucleotide"
ctgggtttattggagggtgc

SEQ ID NO: 663 - DNA, 20 bp, Artificial Sequence
  source: /note="Description of Artificial Sequence: Synthetic oligonucleotide"
gtgagcacttgtgctgcatg

SEQ ID NO: 664 - DNA, 20 bp, Artificial Sequence
  source: /note="Description of Artificial Sequence: Synthetic oligonucleotide"
aaggtgatgcaggcccagat

SEQ ID NO: 665 - DNA, 20 bp, Artificial Sequence
  source: /note="Description of Artificial Sequence: Synthetic oligonucleotide"
gctagctaagggcactgagt

SEQ ID NO: 666 - DNA, 20 bp, Artificial Sequence
  source: /note="Description of Artificial Sequence: Synthetic oligonucleotide"
ggcacagtctgagtggagag

SEQ ID NO: 667 - DNA, 20 bp, Artificial Sequence
  source: /note="Description of Artificial Sequence: Synthetic oligonucleotide"
aggcacagtctgagtggaga

SEQ ID NO: 668 - DNA, 20 bp, Artificial Sequence
  source: /note="Description of Artificial Sequence: Synthetic oligonucleotide"
agtggagagccatgatggca

SEQ ID NO: 669 - DNA, 20 bp, Artificial Sequence
  source: /note="Description of Artificial Sequence: Synthetic oligonucleotide"
ccctgcttgtcatatccatg

SEQ ID NO: 670 - DNA, 20 bp, Artificial Sequence
  source: /note="Description of Artificial Sequence: Synthetic oligonucleotide"
ctggagcctgggtttattgg

SEQ ID NO: 671 - DNA, 20 bp, Artificial Sequence
  source: /note="Description of Artificial Sequence: Synthetic oligonucleotide"
ggcactggccaagacagact

SEQ ID NO: 672 - DNA, 20 bp, Artificial Sequence
  source: /note="Description of Artificial Sequence: Synthetic oligonucleotide"
caggcacagtctgagtggag

SEQ ID NO: 673 - DNA, 20 bp, Artificial Sequence
  source: /note="Description of Artificial Sequence: Synthetic oligonucleotide"
ttaccctctgaacccagtgg

SEQ ID NO: 674 - DNA, 20 bp, Artificial Sequence
  source: /note="Description of Artificial Sequence: Synthetic oligonucleotide"
agcacttgtgctgcatgagg

SEQ ID NO: 675 - DNA, 20 bp, Artificial Sequence
  source: /note="Description of Artificial Sequence: Synthetic oligonucleotide"
gatctgggacttagtcaggc

SEQ ID NO: 676 - DNA, 20 bp, Artificial Sequence
  source: /note="Description of Artificial Sequence: Synthetic oligonucleotide"
gagcctgggtttattggagg

SEQ ID NO: 677 - DNA, 20 bp, Artificial Sequence
  source: /note="Description of Artificial Sequence: Synthetic oligonucleotide"
ggagcctgggtttattggag

SEQ ID NO: 678 - DNA, 20 bp, Artificial Sequence
  source: /note="Description of Artificial Sequence: Synthetic oligonucleotide"
cagccagctttaaggtgtca

SEQ ID NO: 679 - DNA, 20 bp, Artificial Sequence
  source: /note="Description of Artificial Sequence: Synthetic oligonucleotide"
cctgggtttattggagggtg

SEQ ID NO: 680 - DNA, 20 bp, Artificial Sequence
  source: /note="Description of Artificial Sequence: Synthetic oligonucleotide"
atggaagtcacagcagggct

SEQ ID NO: 681 - DNA, 20 bp, Artificial Sequence
  source: /note="Description of Artificial Sequence: Synthetic oligonucleotide"
ctccagtgtctccagaactg

SEQ ID NO: 682 - DNA, 20 bp, Artificial Sequence
  source: /note="Description of Artificial Sequence: Synthetic oligonucleotide"
ggctagctaagggcactgag

SEQ ID NO: 683 - DNA, 20 bp, Artificial Sequence
  source: /note="Description of Artificial Sequence: Synthetic oligonucleotide"
aggctagctaagggcactga

SEQ ID NO: 684 - DNA, 20 bp, Artificial Sequence
  source: /note="Description of Artificial Sequence: Synthetic oligonucleotide"
ggagagaagggtaccaggca

SEQ ID NO: 685 - DNA, 20 bp, Artificial Sequence
  source: /note="Description of Artificial Sequence: Synthetic oligonucleotide"
tggagcctgggtttattgga

SEQ ID NO: 686 - DNA, 20 bp, Artificial Sequence
  source: /note="Description of Artificial Sequence: Synthetic oligonucleotide"
gagagccatgatggcactca

SEQ ID NO: 687 - DNA, 20 bp, Artificial Sequence
  source: /note="Description of Artificial Sequence: Synthetic oligonucleotide"
cttaccctctgaacccagtg

SEQ ID NO: 688 - DNA, 20 bp, Artificial Sequence
  source: /note="Description of Artificial Sequence: Synthetic oligonucleotide"
gcaaagctggctgcagtgac

SEQ ID NO: 689 - DNA, 20 bp, Artificial Sequence
  source: /note="Description of Artificial Sequence: Synthetic oligonucleotide"
caggctagctaagggcactg

SEQ ID NO: 690 - DNA, 20 bp, Artificial Sequence
  source: /note="Description of Artificial Sequence: Synthetic oligonucleotide"
agtctgagtggagagccatg

SEQ ID NO: 691 - DNA, 20 bp, Artificial Sequence
  source: /note="Description of Artificial Sequence: Synthetic oligonucleotide"
ctggcactggccaagacaga

SEQ ID NO: 692 - DNA, 20 bp, Artificial Sequence
  source: /note="Description of Artificial Sequence: Synthetic oligonucleotide"
ctgtctaggctgcttttact

SEQ ID NO: 693 - DNA, 20 bp, Artificial Sequence
  source: /note="Description of Artificial Sequence: Synthetic oligonucleotide"
tggagagccatgatggcact

SEQ ID NO: 694 - DNA, 20 bp, Artificial Sequence
  source: /note="Description of Artificial Sequence: Synthetic oligonucleotide"
agcaaagctggctgcagtga

SEQ ID NO: 695 - DNA, 20 bp, Artificial Sequence
  source: /note="Description of Artificial Sequence: Synthetic oligonucleotide"
gcactggccaagacagactc

SEQ ID NO: 696 - DNA, 20 bp, Artificial Sequence
  source: /note="Description of Artificial Sequence: Synthetic oligonucleotide"
aaccctttgccttttcagga

SEQ ID NO: 697 - DNA, 20 bp, Artificial Sequence
  source: /note="Description of Artificial Sequence: Synthetic oligonucleotide"
cagcaaagctggctgcagtg

SEQ ID NO: 698 - DNA, 20 bp, Artificial Sequence
  source: /note="Description of Artificial Sequence: Synthetic oligonucleotide"
caaccctttgccttttcagg

SEQ ID NO: 699 - DNA, 20 bp, Artificial Sequence
  source: /note="Description of Artificial Sequence: Synthetic oligonucleotide"
tctgtctaggctgcttttac

SEQ ID NO: 700 - DNA, 20 bp, Artificial Sequence
  source: /note="Description of Artificial Sequence: Synthetic oligonucleotide"
gagcacttgtgctgcatgag

SEQ ID NO: 701 - DNA, 20 bp, Artificial Sequence
  source: /note="Description of Artificial Sequence: Synthetic oligonucleotide"
gggcaatgggatattcctgc

SEQ ID NO: 702 - DNA, 20 bp, Artificial Sequence
  source: /note="Description of Artificial Sequence: Synthetic oligonucleotide"
ggtttattggagggtgcttt

SEQ ID NO: 703 - DNA, 20 bp, Artificial Sequence
  source: /note="Description of Artificial Sequence: Synthetic oligonucleotide"
ttctgtctaggctgctttta

SEQ ID NO: 704 - DNA, 20 bp, Artificial Sequence
  source: /note="Description of Artificial Sequence: Synthetic oligonucleotide"
tgagcacttgtgctgcatga

SEQ ID NO: 705 - DNA, 20 bp, Artificial Sequence
  source: /note="Description of Artificial Sequence: Synthetic oligonucleotide"
gtgacaaccctttgcctttt

SEQ ID NO: 706 - DNA, 20 bp, Artificial Sequence
  source: /note="Description of Artificial Sequence: Synthetic oligonucleotide"
ttcttaccctctgaacccag

SEQ ID NO: 707 - DNA, 20 bp, Artificial Sequence
  source: /note="Description of Artificial Sequence: Synthetic oligonucleotide"
tggagagaagggtaccaggc

SEQ ID NO: 708 - DNA, 20 bp, Artificial Sequence
  source: /note="Description of Artificial Sequence: Synthetic oligonucleotide"
agtgtctccagaactgagca

SEQ ID NO: 709 - DNA, 20 bp, Artificial Sequence
  source: /note="Description of Artificial Sequence: Synthetic oligonucleotide"
cagtgtctccagaactgagc

SEQ ID NO: 710 - DNA, 20 bp, Artificial Sequence
  source: /note="Description of Artificial Sequence: Synthetic oligonucleotide"
aaaggtgatgcaggcccaga

SEQ ID NO: 711 - DNA, 20 bp, Artificial Sequence
  source: /note="Description of Artificial Sequence: Synthetic oligonucleotide"
tggcactggccaagacagac

SEQ ID NO: 712 - DNA, 20 bp, Artificial Sequence
  source: /note="Description of Artificial Sequence: Synthetic oligonucleotide"
ggcaatgggatattcctgct

SEQ ID NO: 713 - DNA, 20 bp, Artificial Sequence
  source: /note="Description of Artificial Sequence: Synthetic oligonucleotide"
caaaggtgatgcaggcccag

SEQ ID NO: 714 - DNA, 20 bp, Artificial Sequence
  source: /note="Description of Artificial Sequence: Synthetic oligonucleotide"
gacaaccctttgccttttca

SEQ ID NO: 715 - DNA, 20 bp, Artificial Sequence
  source: /note="Description of Artificial Sequence: Synthetic oligonucleotide"
gttgcaaaatcctatccccc

SEQ ID NO: 716 - DNA, 20 bp, Artificial Sequence
  source: /note="Description of Artificial Sequence: Synthetic oligonucleotide"
caggagctgttccttcagaa

SEQ ID NO: 717 - DNA, 20 bp, Artificial Sequence
  source: /note="Description of Artificial Sequence: Synthetic oligonucleotide"
tcctaagaagagcccaggtt

SEQ ID NO: 718 - DNA, 20 bp, Artificial Sequence
  source: /note="Description of Artificial Sequence: Synthetic oligonucleotide"
ttcctaagaagagcccaggt

SEQ ID NO: 719 - DNA, 20 bp, Artificial Sequence
  source: /note="Description of Artificial Sequence: Synthetic oligonucleotide"
ccagtgtctccagaactgag

SEQ ID NO: 720 - DNA, 20 bp, Artificial Sequence
  source: /note="Description of Artificial Sequence: Synthetic oligonucleotide"
cccaaacctggagtgagacc

SEQ ID NO: 721 - DNA, 20 bp, Artificial Sequence
  source: /note="Description of Artificial Sequence: Synthetic oligonucleotide"
gtttattggagggtgctttc

SEQ ID NO: 722 - DNA, 20 bp, Artificial Sequence
  source: /note="Description of Artificial Sequence: Synthetic oligonucleotide"
cctggagtgagacctttgac

SEQ ID NO: 723 - DNA, 20 bp, Artificial Sequence
  source: /note="Description of Artificial Sequence: Synthetic oligonucleotide"
gagggagagccatttcctaa

SEQ ID NO: 724 - DNA, 20 bp, Artificial Sequence
  source: /note="Description of Artificial Sequence: Synthetic oligonucleotide"
tctgagtggagagccatgat

SEQ ID NO: 725 - DNA, 20 bp, Artificial Sequence
  source: /note="Description of Artificial Sequence: Synthetic oligonucleotide"
gcaatgggatattcctgctc

SEQ ID NO: 726 - DNA, 20 bp, Artificial Sequence
  source: /note="Description of Artificial Sequence: Synthetic oligonucleotide"
tgtctaggctgcttttactg

SEQ ID NO: 727 - DNA, 20 bp, Artificial Sequence
  source: /note="Description of Artificial Sequence: Synthetic oligonucleotide"
acaaccctttgccttttcag

SEQ ID NO: 728 - DNA, 20 bp, Artificial Sequence
  source: /note="Description of Artificial Sequence: Synthetic oligonucleotide"
gactttctgatgatgtggcc

SEQ ID NO: 729 - DNA, 20 bp, Artificial Sequence
  source: /note="Description of Artificial Sequence: Synthetic oligonucleotide"
cactggccaagacagactct

SEQ ID NO: 730 - DNA, 20 bp, Artificial Sequence
  source: /note="Description of Artificial Sequence: Synthetic oligonucleotide"
tgacaaccctttgccttttc

SEQ ID NO: 731 - DNA, 20 bp, Artificial Sequence
  source: /note="Description of Artificial Sequence: Synthetic oligonucleotide"
caactccagtgtctccagaa

SEQ ID NO: 732 - DNA, 20 bp, Artificial Sequence
  source: /note="Description of Artificial Sequence: Synthetic oligonucleotide"
gccagctttaaggtgtcaac

SEQ ID NO: 733 - DNA, 20 bp, Artificial Sequence
  source: /note="Description of Artificial Sequence: Synthetic oligonucleotide"
caaagctggctgcagtgaca

SEQ ID NO: 734 - DNA, 20 bp, Artificial Sequence
  source: /note="Description of Artificial Sequence: Synthetic oligonucleotide"
agccagctttaaggtgtcaa

SEQ ID NO: 735 - DNA, 20 bp, Artificial Sequence
  source: /note="Description of Artificial Sequence: Synthetic oligonucleotide"
gccatttcctaagaagagcc

SEQ ID NO: 736 - DNA, 20 bp, Artificial Sequence
  source: /note="Description of Artificial Sequence: Synthetic oligonucleotide"
cctaagaagagcccaggttg

SEQ ID NO: 737 - DNA, 20 bp, Artificial Sequence
  source: /note="Description of Artificial Sequence: Synthetic oligonucleotide"
ttattggagggtgctttctt

SEQ ID NO: 738 - DNA, 20 bp, Artificial Sequence
  source: /note="Description of Artificial Sequence: Synthetic oligonucleotide"
tgagtggagagccatgatgg

SEQ ID NO: 739 - DNA, 20 bp, Artificial Sequence
  source: /note="Description of Artificial Sequence: Synthetic oligonucleotide"
ccaaacctggagtgagacct

SEQ ID NO: 740 - DNA, 20 bp, Artificial Sequence
  source: /note="Description of Artificial Sequence: Synthetic oligonucleotide"
ccatttcctaagaagagccc

SEQ ID NO: 741 - DNA, 20 bp, Artificial Sequence
  source: /note="Description of Artificial Sequence: Synthetic oligonucleotide"
ctggagtgagacctttgact

SEQ ID NO: 742 - DNA, 20 bp, Artificial Sequence
  source: /note="Description of Artificial Sequence: Synthetic oligonucleotide"
gctgcagtgacaaggaagtc

SEQ ID NO: 743 - DNA, 20 bp, Artificial Sequence
  source: /note="Description of Artificial Sequence: Synthetic oligonucleotide"
aagctggctgcagtgacaag

SEQ ID NO: 744 - DNA, 20 bp, Artificial Sequence
  source: /note="Description of Artificial Sequence: Synthetic oligonucleotide"
ctgagtggagagccatgatg

SEQ ID NO: 745 - DNA, 20 bp, Artificial Sequence
  source: /note="Description of Artificial Sequence: Synthetic oligonucleotide"
tttcctaagaagagcccagg

SEQ ID NO: 746 - DNA, 20 bp, Artificial Sequence
  source: /note="Description of Artificial Sequence: Synthetic oligonucleotide"
ggcaaagatttgtgagggct

SEQ ID NO: 747 - DNA, 20 bp, Artificial Sequence
  source: /note="Description of Artificial Sequence: Synthetic oligonucleotide"
cacttgtgctgcatgaggaa

SEQ ID NO: 748 - DNA, 20 bp, Artificial Sequence
  source: /note="Description of Artificial Sequence: Synthetic oligonucleotide"
cctggagatactcagacact

SEQ ID NO: 749 - DNA, 20 bp, Artificial Sequence
  source: /note="Description of Artificial Sequence: Synthetic oligonucleotide"
tgttgcaaaatcctatcccc

SEQ ID NO: 750 - DNA, 20 bp, Artificial Sequence
  source: /note="Description of Artificial Sequence: Synthetic oligonucleotide"
tggagtgagacctttgactt

SEQ ID NO: 751 - DNA, 20 bp, Artificial Sequence
  source: /note="Description of Artificial Sequence: Synthetic oligonucleotide"
agtgagacctttgactttct

SEQ ID NO: 752 - DNA, 20 bp, Artificial Sequence
  source: /note="Description of Artificial Sequence: Synthetic oligonucleotide"
aacctggagtgagacctttg

SEQ ID NO: 753 - DNA, 20 bp, Artificial Sequence
  source: /note="Description of Artificial Sequence: Synthetic oligonucleotide"
gctgcatgaggaaaggagga

SEQ ID NO: 754 - DNA, 20 bp, Artificial Sequence
  source: /note="Description of Artificial Sequence: Synthetic oligonucleotide"
gtgagacctttgactttctg

SEQ ID NO: 755 - DNA, 20 bp, Artificial Sequence
  source: /note="Description of Artificial Sequence: Synthetic oligonucleotide"
catttcctaagaagagccca

SEQ ID NO: 756 - DNA, 20 bp, Artificial Sequence
  source: /note="Description of Artificial Sequence: Synthetic oligonucleotide"
aaagctggctgcagtgacaa

SEQ ID NO: 757 - DNA, 20 bp, Artificial Sequence
  source: /note="Description of Artificial Sequence: Synthetic oligonucleotide"
tgactttctgatgatgtggc

SEQ ID NO: 758 - DNA, 20 bp, Artificial Sequence
  source: /note="Description of Artificial Sequence: Synthetic oligonucleotide"
agccatttcctaagaagagc

SEQ ID NO: 759 - DNA, 20 bp, Artificial Sequence
  source: /note="Description of Artificial Sequence: Synthetic oligonucleotide"
caaacctggagtgagacctt

SEQ ID NO: 760 - DNA, 20 bp, Artificial Sequence
  source: /note="Description of Artificial Sequence: Synthetic oligonucleotide"
tggcaaagatttgtgagggc

SEQ ID NO: 761 - DNA, 20 bp, Artificial Sequence
  source: /note="Description of Artificial Sequence: Synthetic oligonucleotide"
tgtgctgcatgaggaaagga

SEQ ID NO: 762 - DNA, 20 bp, Artificial Sequence
  source: /note="Description of Artificial Sequence: Synthetic oligonucleotide"
atttcctaagaagagcccag

SEQ ID NO: 763 - DNA, 20 bp, Artificial Sequence
  source: /note="Description of Artificial Sequence: Synthetic oligonucleotide"
ctgcagtgacaaggaagtca

SEQ ID NO: 764 - DNA, 20 bp, Artificial Sequence
  source: /note="Description of Artificial Sequence: Synthetic oligonucleotide"
gcaaagatttgtgagggctt

SEQ ID NO: 765 - DNA, 20 bp, Artificial Sequence
  source: /note="Description of Artificial Sequence: Synthetic oligonucleotide"
gcagtgacaaggaagtcaga

SEQ ID NO: 766 - DNA, 20 bp, Artificial Sequence
  source: /note="Description of Artificial Sequence: Synthetic oligonucleotide"
gtgctttagagatttgctac

SEQ ID NO: 767 - DNA, 20 bp, Artificial Sequence
  source: /note="Description of Artificial Sequence: Synthetic oligonucleotide"
aaacctggagtgagaccttt

SEQ ID NO: 768 - DNA, 20 bp, Artificial Sequence
  source: /note="Description of Artificial Sequence: Synthetic oligonucleotide"
ggaatggagagaagggtacc

SEQ ID NO: 769 - DNA, 20 bp, Artificial Sequence
  source: /note="Description of Artificial Sequence: Synthetic oligonucleotide"
tgagacctttgactttctga

SEQ ID NO: 770 - DNA, 20 bp, Artificial Sequence
  source: /note="Description of Artificial Sequence: Synthetic oligonucleotide"
tggagatactcagacactgt

SEQ ID NO: 771 - DNA, 20 bp, Artificial Sequence
  source: /note="Description of Artificial Sequence: Synthetic oligonucleotide"
ttgtgctgcatgaggaaagg

SEQ ID NO: 772 - DNA, 20 bp, Artificial Sequence
  source: /note="Description of Artificial Sequence: Synthetic oligonucleotide"
ttgttgcaaaatcctatccc

SEQ ID NO: 773 - DNA, 20 bp, Artificial Sequence
  source: /note="Description of Artificial Sequence: Synthetic oligonucleotide"
acttgtgctgcatgaggaaa

SEQ ID NO: 774 - DNA, 20 bp, Artificial Sequence
  source: /note="Description of Artificial Sequence: Synthetic oligonucleotide"
ggagatactcagacactgta

SEQ ID NO: 775 - DNA, 20 bp, Artificial Sequence
  source: /note="Description of Artificial Sequence: Synthetic oligonucleotide"
ggagacagacaacccaatgg

SEQ ID NO: 776 - DNA, 20 bp, Artificial Sequence
  source: /note="Description of Artificial Sequence: Synthetic oligonucleotide"
ctgctagattctttgaagca

SEQ ID NO: 777 - DNA, 20 bp, Artificial Sequence
  source: /note="Description of Artificial Sequence: Synthetic oligonucleotide"
cttgtgctgcatgaggaaag

SEQ ID NO: 778 - DNA, 20 bp, Artificial Sequence
  source: /note="Description of Artificial Sequence: Synthetic oligonucleotide"
tgaggaaaggaggatcaggt

SEQ ID NO: 779 - DNA, 20 bp, Artificial Sequence
  source: /note="Description of Artificial Sequence: Synthetic oligonucleotide"
tgcagtgacaaggaagtcag

SEQ ID NO: 780 - DNA, 20 bp, Artificial Sequence
  source: /note="Description of Artificial Sequence: Synthetic oligonucleotide"
gtggcaaaagataccacacc

SEQ ID NO: 781 - DNA, 20 bp, Artificial Sequence
  source: /note="Description of Artificial Sequence: Synthetic oligonucleotide"
gcatgaggaaaggaggatca

SEQ ID NO: 782 - DNA, 20 bp, Artificial Sequence
  source: /note="Description of Artificial Sequence: Synthetic oligonucleotide"
gagccatttcctaagaagag

SEQ ID NO: 783 - DNA, 20 bp, Artificial Sequence
  source: /note="Description of Artificial Sequence: Synthetic oligonucleotide"
agagccatttcctaagaaga

SEQ ID NO: 784 - DNA, 20 bp, Artificial Sequence
  source: /note="Description of Artificial Sequence: Synthetic oligonucleotide"
ggagaagggaatgcagaacc

SEQ ID NO: 785 - DNA, 20 bp, Artificial Sequence
  source: /note="Description of Artificial Sequence: Synthetic oligonucleotide"
tctcaggaaagcaattccac

SEQ ID NO: 786 - DNA, 20 bp, Artificial Sequence
  source: /note="Description of Artificial Sequence: Synthetic oligonucleotide"
caaagatttgtgagggcttc

SEQ ID NO: 787 - DNA, 20 bp, Artificial Sequence
  source: /note="Description of Artificial Sequence: Synthetic oligonucleotide"
ctgcatgaggaaaggaggat

SEQ ID NO: 788 - DNA, 20 bp, Artificial Sequence
  source: /note="Description of Artificial Sequence: Synthetic oligonucleotide"
aatggagagaagggtaccag

SEQ ID NO: 789 - DNA, 20 bp, Artificial Sequence
  source: /note="Description of Artificial Sequence: Synthetic oligonucleotide"
aaatggaagtcacagcaggg

SEQ ID NO: 790 - DNA, 20 bp, Artificial Sequence
  source: /note="Description of Artificial Sequence: Synthetic oligonucleotide"
gatactgaggaaagtgggtt

SEQ ID NO: 791 - DNA, 20 bp, Artificial Sequence
  source: /note="Description of Artificial Sequence: Synthetic oligonucleotide"
tgcatgaggaaaggaggatc

SEQ ID NO: 792 - DNA, 20 bp, Artificial Sequence
  source: /note="Description of Artificial Sequence: Synthetic oligonucleotide"
agatactgaggaaagtgggt

SEQ ID NO: 793 - DNA, 20 bp, Artificial Sequence
  source: /note="Description of Artificial Sequence: Synthetic oligonucleotide"
gagatactcagacactgtat

SEQ ID NO: 794 - DNA, 20 bp, Artificial Sequence
  source: /note="Description of Artificial Sequence: Synthetic oligonucleotide"
atggcaaagatttgtgaggg

SEQ ID NO: 795 - DNA, 20 bp, Artificial Sequence
  source: /note="Description of Artificial Sequence: Synthetic oligonucleotide"
attctcaggaaagcaattcc

SEQ ID NO: 796 - DNA, 20 bp, Artificial Sequence
  source: /note="Description of Artificial Sequence: Synthetic oligonucleotide"
aggaatggagagaagggtac

SEQ ID NO: 797 - DNA, 20 bp, Artificial Sequence
  source: /note="Description of Artificial Sequence: Synthetic oligonucleotide"
gattctttgaagcaagggag

SEQ ID NO: 798 - DNA, 20 bp, Artificial Sequence
  source: /note="Description of Artificial Sequence: Synthetic oligonucleotide"
agattctttgaagcaaggga

SEQ ID NO: 799 - DNA, 20 bp, Artificial Sequence
  source: /note="Description of Artificial Sequence: Synthetic oligonucleotide"
gaaatggaagtcacagcagg

SEQ ID NO: 800 - DNA, 20 bp, Artificial Sequence
  source: /note="Description of Artificial Sequence: Synthetic oligonucleotide"
ggaaatggaagtcacagcag

SEQ ID NO: 801 - DNA, 20 bp, Artificial Sequence
  source: /note="Description of Artificial Sequence: Synthetic oligonucleotide"
tttgttgcaaaatcctatcc

SEQ ID NO: 802 - DNA, 20 bp, Artificial Sequence
  source: /note="Description of Artificial Sequence: Synthetic oligonucleotide"
atgaggaaaggaggatcagg

SEQ ID NO: 803 - DNA, 20 bp, Artificial Sequence
  source: /note="Description of Artificial Sequence: Synthetic oligonucleotide"
tggaaatggaagtcacagca

SEQ ID NO: 804 - DNA, 20 bp, Artificial Sequence
  source: /note="Description of Artificial Sequence: Synthetic oligonucleotide"
agatactcagacactgtatt

SEQ ID NO: 805 - DNA, 20 bp, Artificial Sequence
  source: /note="Description of Artificial Sequence: Synthetic oligonucleotide"
gctagattctttgaagcaag

SEQ ID NO: 806 - DNA, 20 bp, Artificial Sequence
  source: /note="Description of Artificial Sequence: Synthetic oligonucleotide"
tgctagattctttgaagcaa

SEQ ID NO: 807 - DNA, 20 bp, Artificial Sequence
  source: /note="Description of Artificial Sequence: Synthetic oligonucleotide"
aggagaagggaatgcagaac

SEQ ID NO: 808 - DNA, 20 bp, Artificial Sequence
  source: /note="Description of Artificial Sequence: Synthetic oligonucleotide"
atggaaatggaagtcacagc

SEQ ID NO: 809 - DNA, 20 bp, Artificial Sequence
  source: /note="Description of Artificial Sequence: Synthetic oligonucleotide"
catgaggaaaggaggatcag

SEQ ID NO: 810 - DNA, 20 bp, Artificial Sequence
  source: /note="Description of Artificial Sequence: Synthetic oligonucleotide"
tagattctttgaagcaaggg

SEQ ID NO: 811 - DNA, 20 bp, Artificial Sequence
  source: /note="Description of Artificial Sequence: Synthetic oligonucleotide"
ttctttgaagcaagggagaa

SEQ ID NO: 812 - DNA, 20 bp, Artificial Sequence
  source: /note="Description of Artificial Sequence: Synthetic oligonucleotide"
gattctcaggaaagcaattc

SEQ ID NO: 813 - DNA, 20 bp, Artificial Sequence
  source: /note="Description of Artificial Sequence: Synthetic oligonucleotide"
ctagattctttgaagcaagg

SEQ ID NO: 814 - DNA, 20 bp, Artificial Sequence
  source: /note="Description of Artificial Sequence: Synthetic oligonucleotide"
gaatgattctcaggaaagca

SEQ ID NO: 815 - DNA, 20 bp, Artificial Sequence
  source: /note="Description of Artificial Sequence: Synthetic oligonucleotide"
ttttgttgcaaaatcctatc

SEQ ID NO: 816 - DNA, 20 bp, Artificial Sequence
  source: /note="Description of Artificial Sequence: Synthetic oligonucleotide"
tgattctcaggaaagcaatt

SEQ ID NO: 817 - DNA, 20 bp, Artificial Sequence
  source: /note="Description of Artificial Sequence: Synthetic oligonucleotide"
agaatgattctcaggaaagc

SEQ ID NO: 818 - DNA, 20 bp, Artificial Sequence
  source: /note="Description of Artificial Sequence: Synthetic oligonucleotide"
atgattctcaggaaagcaat

SEQ ID NO: 819 - DNA, 20 bp, Artificial Sequence
  source: /note="Description of Artificial Sequence: Synthetic oligonucleotide"
aatggcaaagatttgtgagg

SEQ ID NO: 820 - DNA, 20 bp, Artificial Sequence
  source: /note="Description of Artificial Sequence: Synthetic oligonucleotide"
gatggaaatggaagtcacag

SEQ ID NO: 821 - DNA, 20 bp, Artificial Sequence
  source: /note="Description of Artificial Sequence: Synthetic oligonucleotide"
aatgattctcaggaaagcaa

SEQ ID NO: 822 - DNA, 20 bp, Artificial Sequence
  source: /note="Description of Artificial Sequence: Synthetic oligonucleotide"
aaatggcaaagatttgtgag

SEQ ID NO: 823 - DNA, 20 bp, Artificial Sequence
  source: /note="Description of Artificial Sequence: Synthetic oligonucleotide"
ctcaagctgactgctatcag

SEQ ID NO: 824 - DNA, 20 bp, Artificial Sequence
  source: /note="Description of Artificial Sequence: Synthetic oligonucleotide"
tcctcaagctgactgctatc

SEQ ID NO: 825 - DNA, 20 bp, Artificial Sequence
  source: /note="Description of Artificial Sequence: Synthetic oligonucleotide"
cctcaagctgactgctatca

SEQ ID NO: 826 - DNA, 20 bp, Artificial Sequence
  source: /note="Description of Artificial Sequence: Synthetic oligonucleotide"
agacactgtattgttattgg

SEQ ID NO: 827 - DNA, 20 bp, Artificial Sequence
  source: /note="Description of Artificial Sequence: Synthetic oligonucleotide"
atgggatattcctgctctgt

SEQ ID NO: 828 - DNA, 20 bp, Artificial Sequence
  source: /note="Description of Artificial Sequence: Synthetic oligonucleotide"
gatagcaccaacacaaagtt

SEQ ID NO: 829 - DNA, 20 bp, Artificial Sequence
  source: /note="Description of Artificial Sequence: Synthetic oligonucleotide"
gcccccatctggcccaggca

SEQ ID NO: 830 - DNA, 20 bp, Artificial Sequence
  source: /note="Description of Artificial Sequence: Synthetic oligonucleotide"
aagagccttcagcagccccc

SEQ ID NO: 831 - DNA, 20 bp, Artificial Sequence
  source: /note="Description of Artificial Sequence: Synthetic oligonucleotide"
gctgtcctgtgagggcagtg

SEQ ID NO: 832 - DNA, 20 bp, Artificial Sequence
  source: /note="Description of Artificial Sequence: Synthetic oligonucleotide"
agtgggtagccctggatggc

SEQ ID NO: 833 - DNA, 20 bp, Artificial Sequence
  source: /note="Description of Artificial Sequence: Synthetic oligonucleotide"
tgtatggcctctgggtcagc

SEQ ID NO: 834 - DNA, 20 bp, Artificial Sequence
  source: /note="Description of Artificial Sequence: Synthetic oligonucleotide"
gcctggtccctgagtaagca

SEQ ID NO: 835 - DNA, 20 bp, Artificial Sequence
  source: /note="Description of Artificial Sequence: Synthetic oligonucleotide"
tgtctcagcccagggagact

SEQ ID NO: 836 - DNA, 20 bp, Artificial Sequence
  source: /note="Description of Artificial Sequence: Synthetic oligonucleotide"
ggagggtgctttcttaccct

SEQ ID NO: 837 - DNA, 20 bp, Artificial Sequence
  source: /note="Description of Artificial Sequence: Synthetic oligonucleotide"
agggtgctttcttaccctct

SEQ ID NO: 838 - DNA, 20 bp, Artificial Sequence
  source: /note="Description of Artificial Sequence: Synthetic oligonucleotide"
gggtgctttcttaccctctg

SEQ ID NO: 839 - DNA, 20 bp, Artificial Sequence
  source: /note="Description of Artificial Sequence: Synthetic oligonucleotide"
gagggtgctttcttaccctc

SEQ ID NO: 840 - DNA, 20 bp, Artificial Sequence
  source: /note="Description of Artificial Sequence: Synthetic oligonucleotide"
cctctgggtcagctttttgt

SEQ ID NO: 841 - DNA, 20 bp, Artificial Sequence
  source: /note="Description of Artificial Sequence: Synthetic oligonucleotide"
agtaagcagtgggtagccct

SEQ ID NO: 842 - DNA, 20 bp, Artificial Sequence
  source: /note="Description of Artificial Sequence: Synthetic oligonucleotide"
ggtttcaggagctgttcctt

SEQ ID NO: 843 - DNA, 20 bp, Artificial Sequence
  source: /note="Description of Artificial Sequence: Synthetic oligonucleotide"
gtaagcagtgggtagccctg

SEQ ID NO: 844 - DNA, 20 bp, Artificial Sequence
  source: /note="Description of Artificial Sequence: Synthetic oligonucleotide"
gagtaagcagtgggtagccc

SEQ ID NO: 845 - DNA, 20 bp, Artificial Sequence
  source: /note="Description of Artificial Sequence: Synthetic oligonucleotide"
ggtgctttcttaccctctga

SEQ ID NO: 846 - DNA, 20 bp, Artificial Sequence
  source: /note="Description of Artificial Sequence: Synthetic oligonucleotide"
tccctgagtaagcagtgggt

SEQ ID NO: 847 - DNA, 20 bp, Artificial Sequence
  source: /note="Description of Artificial Sequence: Synthetic oligonucleotide"
gtccctgagtaagcagtggg

SEQ ID NO: 848 - DNA, 20 bp, Artificial Sequence
  source: /note="Description of Artificial Sequence: Synthetic oligonucleotide"
ggtccctgagtaagcagtgg

SEQ ID NO: 849 - DNA, 20 bp, Artificial Sequence
  source: /note="Description of Artificial Sequence: Synthetic oligonucleotide"
gggacttagtcaggctagct

SEQ ID NO: 850 - DNA, 20 bp, Artificial Sequence
  source: /note="Description of Artificial Sequence: Synthetic oligonucleotide"
taagcagtgggtagccctgg

SEQ ID NO: 851 - DNA, 20 bp, Artificial Sequence
  source: /note="Description of Artificial Sequence: Synthetic oligonucleotide"
ggtgagcacttgtgctgcat

SEQ ID NO: 852 - DNA, 20 bp, Artificial Sequence
  source: /note="Description of Artificial Sequence: Synthetic oligonucleotide"
cctggtccctgagtaagcag

SEQ ID NO: 853 - DNA, 20 bp, Artificial Sequence
  source: /note="Description of Artificial Sequence: Synthetic oligonucleotide"
ctggtccctgagtaagcagt

SEQ ID NO: 854 - DNA, 20 bp, Artificial Sequence
  source: /note="Description of Artificial Sequence: Synthetic oligonucleotide"
gggactggttaggttggacc

SEQ ID NO: 855 - DNA, 20 bp, Artificial Sequence
  source: /note="Description of Artificial Sequence: Synthetic oligonucleotide"
ggagggagagccatttccta

SEQ ID NO: 856 - DNA, 20 bp, Artificial Sequence
  source: /note="Description of Artificial Sequence: Synthetic oligonucleotide"
ccctgagtaagcagtgggta

SEQ ID NO: 857 - DNA, 20 bp, Artificial Sequence
  source: /note="Description of Artificial Sequence: Synthetic oligonucleotide"
tgggacttagtcaggctagc

SEQ ID NO: 858 - DNA, 20 bp, Artificial Sequence
  source: /note="Description of Artificial Sequence: Synthetic oligonucleotide"
gctccaggtgatagcaccaa

SEQ ID NO: 859 - DNA, 20 bp, Artificial Sequence
  source: /note="Description of Artificial Sequence: Synthetic oligonucleotide"
ggaaagagccttcagcagcc

SEQ ID NO: 860 - DNA, 20 bp, Artificial Sequence
  source: /note="Description of Artificial Sequence: Synthetic oligonucleotide"
tggtccctgagtaagcagtg

SEQ ID NO: 861 - DNA, 20 bp, Artificial Sequence
  source: /note="Description of Artificial Sequence: Synthetic oligonucleotide"
tgagtaagcagtgggtagcc

SEQ ID NO: 862 - DNA, 20 bp, Artificial Sequence
  source: /note="Description of Artificial Sequence: Synthetic oligonucleotide"
tctgggacttagtcaggcta

SEQ ID NO: 863 - DNA, 20 bp, Artificial Sequence
  source: /note="Description of Artificial Sequence: Synthetic oligonucleotide"
ggacttagtcaggctagcta

SEQ ID NO: 864 - DNA, 20 bp, Artificial Sequence
  source: /note="Description of Artificial Sequence: Synthetic oligonucleotide"
gggaaagagccttcagcagc

SEQ ID NO: 865 - DNA, 20 bp, Artificial Sequence
  source: /note="Description of Artificial Sequence: Synthetic oligonucleotide"
gtgctttcttaccctctgaa

SEQ ID NO: 866 - DNA, 20 bp, Artificial Sequence
  source: /note="Description of Artificial Sequence: Synthetic oligonucleotide"
ctgggacttagtcaggctag

SEQ ID NO: 867 - DNA, 20 bp, Artificial Sequence
  source: /note="Description of Artificial Sequence: Synthetic oligonucleotide"
ctgagtaagcagtgggtagc

SEQ ID NO: 868 - DNA, 20 bp, Artificial Sequence
  source: /note="Description of Artificial Sequence: Synthetic oligonucleotide"
agtgacaaccctttgccttt

SEQ ID NO: 869 - DNA, 20 bp, Artificial Sequence
  source: /note="Description of Artificial Sequence: Synthetic oligonucleotide"
cctgagtaagcagtgggtag

SEQ ID NO: 870 - DNA, 20 bp, Artificial Sequence
  source: /note="Description of Artificial Sequence: Synthetic oligonucleotide"
agaactaggagtcacctggc

SEQ ID NO: 871 - DNA, 20 bp, Artificial Sequence
  source: /note="Description of Artificial Sequence: Synthetic oligonucleotide"
ctccaggtgatagcaccaac

SEQ ID NO: 872 - DNA, 20 bp, Artificial Sequence
  source: /note="Description of Artificial Sequence: Synthetic oligonucleotide"
actttctgatgatgtggcca

SEQ ID NO: 873 - DNA, 20 bp, Artificial Sequence
  source: /note="Description of Artificial Sequence: Synthetic oligonucleotide"
tccaggtgatagcaccaaca

SEQ ID NO: 874 - DNA, 20 bp, Artificial Sequence
  source: /note="Description of Artificial Sequence: Synthetic oligonucleotide"
ttagtcaggctagctaaggg

SEQ ID NO: 875 - DNA, 20 bp, Artificial Sequence
  source: /note="Description of Artificial Sequence: Synthetic oligonucleotide"
attggagggtgctttcttac

SEQ ID NO: 876 - DNA, 20 bp, Artificial Sequence
  source: /note="Description of Artificial Sequence: Synthetic oligonucleotide"
gtggccaagaactaggagtc

SEQ ID NO: 877 - DNA, 20 bp, Artificial Sequence
  source: /note="Description of Artificial Sequence: Synthetic oligonucleotide"
tgctttcttaccctctgaac

SEQ ID NO: 878 - DNA, 20 bp, Artificial Sequence
  source: /note="Description of Artificial Sequence: Synthetic oligonucleotide"
aagtgacaaccctttgcctt

SEQ ID NO: 879 - DNA, 20 bp, Artificial Sequence
  source: /note="Description of Artificial Sequence: Synthetic oligonucleotide"
cttagtcaggctagctaagg

SEQ ID NO: 880 - DNA, 20 bp, Artificial Sequence
  source: /note="Description of Artificial Sequence: Synthetic oligonucleotide"
tattggagggtgctttctta

SEQ ID NO: 881 - DNA, 20 bp, Artificial Sequence
  source: /note="Description of Artificial Sequence: Synthetic oligonucleotide"
taagtgacaaccctttgcct

SEQ ID NO: 882 - DNA, 20 bp, Artificial Sequence
  source: /note="Description of Artificial Sequence: Synthetic oligonucleotide"
caatgggatattcctgctct

SEQ ID NO: 883 - DNA, 20 bp, Artificial Sequence
  source: /note="Description of Artificial Sequence: Synthetic oligonucleotide"
gacttagtcaggctagctaa

SEQ ID NO: 884 - DNA, 20 bp, Artificial Sequence
  source: /note="Description of Artificial Sequence: Synthetic oligonucleotide"
tgtggccaagaactaggagt

SEQ ID NO: 885 - DNA, 20 bp, Artificial Sequence
  source: /note="Description of Artificial Sequence: Synthetic oligonucleotide"
gctgctagattctttgaagc

SEQ ID NO: 886 - DNA, 20 bp, Artificial Sequence
  source: /note="Description of Artificial Sequence: Synthetic oligonucleotide"
ctttctgatgatgtggccaa

SEQ ID NO: 887 - DNA, 20 bp, Artificial Sequence
  source: /note="Description of Artificial Sequence: Synthetic oligonucleotide"
ccagctttaaggtgtcaaca

SEQ ID NO: 888 - DNA, 20 bp, Artificial Sequence
  source: /note="Description of Artificial Sequence: Synthetic oligonucleotide"
acttagtcaggctagctaag

SEQ ID NO: 889 - DNA, 20 bp, Artificial Sequence
  source: /note="Description of Artificial Sequence: Synthetic oligonucleotide"
aatgggatattcctgctctg

SEQ ID NO: 890 - DNA, 20 bp, Artificial Sequence
  source: /note="Description of Artificial Sequence: Synthetic oligonucleotide"
ttctgatgatgtggccaaga

SEQ ID NO: 891 - DNA, 20 bp, Artificial Sequence
  source: /note="Description of Artificial Sequence: Synthetic oligonucleotide"
agctttaaggtgtcaacacc

SEQ ID NO: 892 - DNA, 20 bp, Artificial Sequence
  source: /note="Description of Artificial Sequence: Synthetic oligonucleotide"
gtgctgcatgaggaaaggag

SEQ ID NO: 893 - DNA, 20 bp, Artificial Sequence
  source: /note="Description of Artificial Sequence: Synthetic oligonucleotide"
gatgtggccaagaactagga

SEQ ID NO: 894 - DNA, 20 bp, Artificial Sequence
  source: /note="Description of Artificial Sequence: Synthetic oligonucleotide"
tttctgatgatgtggccaag

SEQ ID NO: 895 - DNA, 20 bp, Artificial Sequence
  source: /note="Description of Artificial Sequence: Synthetic oligonucleotide"
gagacctttgactttctgat

SEQ ID NO: 896 - DNA, 20 bp, Artificial Sequence
  source: /note="Description of Artificial Sequence: Synthetic oligonucleotide"
gacctttgactttctgatga

SEQ ID NO: 897 - DNA, 20 bp, Artificial Sequence
  source: /note="Description of Artificial Sequence: Synthetic oligonucleotide"
atgtggccaagaactaggag

SEQ ID NO: 898 - DNA, 20 bp, Artificial Sequence
  source: /note="Description of Artificial Sequence: Synthetic oligonucleotide"
gacactgtattgttattggc

SEQ ID NO: 899 - DNA, 20 bp, Artificial Sequence
  source: /note="Description of Artificial Sequence: Synthetic oligonucleotide"
agacctttgactttctgatg

SEQ ID NO: 900 - DNA, 20 bp, Artificial Sequence
  source: /note="Description of Artificial Sequence: Synthetic oligonucleotide"
cagctttaaggtgtcaacac

SEQ ID NO: 901 - DNA, 20 bp, Artificial Sequence
  source: /note="Description of Artificial Sequence: Synthetic oligonucleotide"
acctttgactttctgatgat

SEQ ID NO: 902 - DNA, 20 bp, Artificial Sequence
  source: /note="Description of Artificial Sequence: Synthetic oligonucleotide"
tagcaccaacacaaagttgc

SEQ ID NO: 903 - DNA, 20 bp, Artificial Sequence
  source: /note="Description of Artificial Sequence: Synthetic oligonucleotide"
ggtgatagcaccaacacaaa

SEQ ID NO: 904 - DNA, 20 bp, Artificial Sequence
  source: /note="Description of Artificial Sequence: Synthetic oligonucleotide"
tgatagcaccaacacaaagt

SEQ ID NO: 905 - DNA, 20 bp, Artificial Sequence
  source: /note="Description of Artificial Sequence: Synthetic oligonucleotide"
gtgatagcaccaacacaaag

SEQ ID NO: 906 - DNA, 20 bp, Artificial Sequence
  source: /note="Description of Artificial Sequence: Synthetic oligonucleotide"
ctttttgttgcaaaatccta

SEQ ID NO: 907 - DNA, 20 bp, Artificial Sequence
  source: /note="Description of Artificial Sequence: Synthetic oligonucleotide"
atagcaccaacacaaagttg

SEQ ID NO: 908 - DNA, 20 bp, Artificial Sequence
  source: /note="Description of Artificial Sequence: Synthetic oligonucleotide"
tcaagctgactgctatcagc

SEQ ID NO: 909 - DNA, 20 bp, Artificial Sequence
  source: /note="Description of Artificial Sequence: Synthetic oligonucleotide"
tccatgccctggctctggcc

SEQ ID NO: 910 - DNA, 20 bp, Artificial Sequence
  source: /note="Description of Artificial Sequence: Synthetic oligonucleotide"
ctcagcccagggagactggt

SEQ ID NO: 911 - DNA, 20 bp, Artificial Sequence
  source: /note="Description of Artificial Sequence: Synthetic oligonucleotide"
gtctcagcccagggagactg

SEQ ID NO: 912 - DNA, 20 bp, Artificial Sequence
  source: /note="Description of Artificial Sequence: Synthetic oligonucleotide"
ggtgtcaacacctggccctt

SEQ ID NO: 913 - DNA, 20 bp, Artificial Sequence
  source: /note="Description of Artificial Sequence: Synthetic oligonucleotide"
tcagcccagggagactggtt

SEQ ID NO: 914 - DNA, 20 bp, Artificial Sequence
  source: /note="Description of Artificial Sequence: Synthetic oligonucleotide"
tctcagcccagggagactgg

SEQ ID NO: 915 - DNA, 20 bp, Artificial Sequence
  source: /note="Description of Artificial Sequence: Synthetic oligonucleotide"
tgtcatatccatgccctggc

SEQ ID NO: 916 - DNA, 20 bp, Artificial Sequence
  source: /note="Description of Artificial Sequence: Synthetic oligonucleotide"
cagcccagggagactggttt

SEQ ID NO: 917 - DNA, 20 bp, Artificial Sequence
  source: /note="Description of Artificial Sequence: Synthetic oligonucleotide"
tcctcctcaagctgactgct

SEQ ID NO: 918 - DNA, 20 bp, Artificial Sequence
  source: /note="Description of Artificial Sequence: Synthetic oligonucleotide"
aaagagccttcagcagcccc

SEQ ID NO: 919 - DNA, 20 bp, Artificial Sequence
  source: /note="Description of Artificial Sequence: Synthetic oligonucleotide"
ctggtttcaggagctgttcc

SEQ ID NO: 920 - DNA, 20 bp, Artificial Sequence
  source: /note="Description of Artificial Sequence: Synthetic oligonucleotide"
aagtcagagggagggctggt

SEQ ID NO: 921 - DNA, 20 bp, Artificial Sequence
  source: /note="Description of Artificial Sequence: Synthetic oligonucleotide"
gaaagagccttcagcagccc

SEQ ID NO: 922 - DNA, 20 bp, Artificial Sequence
  source: /note="Description of Artificial Sequence: Synthetic oligonucleotide"
cctcctcaagctgactgcta

SEQ ID NO: 923 - DNA, 20 bp, Artificial Sequence
  source: /note="Description of Artificial Sequence: Synthetic oligonucleotide"
ctgggtcagctttttgttgc

SEQ ID NO: 924 - DNA, 20 bp, Artificial Sequence
  source: /note="Description of Artificial Sequence: Synthetic oligonucleotide"
ttgtcatatccatgccctgg

SEQ ID NO: 925 - DNA, 20 bp, Artificial Sequence
  source: /note="Description of Artificial Sequence: Synthetic oligonucleotide"
tctgggtcagctttttgttg

SEQ ID NO: 926 - DNA, 20 bp, Artificial Sequence
  source: /note="Description of Artificial Sequence: Synthetic oligonucleotide"
gccctaagtgacaacccttt

SEQ ID NO: 927 - DNA, 20 bp, Artificial Sequence
  source: /note="Description of Artificial Sequence: Synthetic oligonucleotide"
tgggatattcctgctctgta

SEQ ID NO: 928 - DNA, 20 bp, Artificial Sequence
  source: /note="Description of Artificial Sequence: Synthetic oligonucleotide"
ctcctcaagctgactgctat

SEQ ID NO: 929 - DNA, 20 bp, Artificial Sequence
  source: /note="Description of Artificial Sequence: Synthetic oligonucleotide"
gccaagaactaggagtcacc

SEQ ID NO: 930 - DNA, 20 bp, Artificial Sequence
  source: /note="Description of Artificial Sequence: Synthetic oligonucleotide"
ctaagtgacaaccctttgcc

SEQ ID NO: 931 - DNA, 20 bp, Artificial Sequence
  source: /note="Description of Artificial Sequence: Synthetic oligonucleotide"
cctaagtgacaaccctttgc

SEQ ID NO: 932 - DNA, 20 bp, Artificial Sequence
  source: /note="Description of Artificial Sequence: Synthetic oligonucleotide"
gctttaaggtgtcaacacct

SEQ ID NO: 933 - DNA, 20 bp, Artificial Sequence
  source: /note="Description of Artificial Sequence: Synthetic oligonucleotide"
ggccaagaactaggagtcac

SEQ ID NO: 934 - DNA, 20 bp, Artificial Sequence
  source: /note="Description of Artificial Sequence: Synthetic oligonucleotide"
ccctaagtgacaaccctttg

SEQ ID NO: 935 - DNA, 20 bp, Artificial Sequence
  source: /note="Description of Artificial Sequence: Synthetic oligonucleotide"
tggccaagaactaggagtca

SEQ ID NO: 936 - DNA, 20 bp, Artificial Sequence
  source: /note="Description of Artificial Sequence: Synthetic oligonucleotide"
ccaagaactaggagtcacct

SEQ ID NO: 937 - DNA, 20 bp, Artificial Sequence
  source: /note="Description of Artificial Sequence: Synthetic oligonucleotide"
gcaggagaagggaatgcaga

SEQ ID NO: 938 - DNA, 20 bp, Artificial Sequence
  source: /note="Description of Artificial Sequence: Synthetic oligonucleotide"
aagaactaggagtcacctgg

SEQ ID NO: 939 - DNA, 20 bp, Artificial Sequence
  source: /note="Description of Artificial Sequence: Synthetic oligonucleotide"
tttaaggtgtcaacacctgg

SEQ ID NO: 940 - DNA, 20 bp, Artificial Sequence
  source: /note="Description of Artificial Sequence: Synthetic oligonucleotide"
tgatgtggccaagaactagg

SEQ ID NO: 941 - DNA, 20 bp, Artificial Sequence
  source: /note="Description of Artificial Sequence: Synthetic oligonucleotide"
tctgatgatgtggccaagaa

SEQ ID NO: 942 - DNA, 20 bp, Artificial Sequence
  source: /note="Description of Artificial Sequence: Synthetic oligonucleotide"
ctttaaggtgtcaacacctg

SEQ ID NO: 943 - DNA, 20 bp, Artificial Sequence
  source: /note="Description of Artificial Sequence: Synthetic oligonucleotide"
gctttttgttgcaaaatcct

SEQ ID NO: 944 - DNA, 20 bp, Artificial Sequence
  source: /note="Description of Artificial Sequence: Synthetic oligonucleotide"
tgatgatgtggccaagaact

SEQ ID NO: 945 - DNA, 20 bp, Artificial Sequence
  source: /note="Description of Artificial Sequence: Synthetic oligonucleotide"
ctgatgatgtggccaagaac

SEQ ID NO: 946 - DNA, 20 bp, Artificial Sequence
  source: /note="Description of Artificial Sequence: Synthetic oligonucleotide"
caagaactaggagtcacctg

SEQ ID NO: 947 - DNA, 20 bp, Artificial Sequence
  source: /note="Description of Artificial Sequence: Synthetic oligonucleotide"
gatgatgtggccaagaacta

SEQ ID NO: 948 - DNA, 20 bp, Artificial Sequence
  source: /note="Description of Artificial Sequence: Synthetic oligonucleotide"
atgatgtggccaagaactag

SEQ ID NO: 949 - DNA, 20 bp, Artificial Sequence
  source: /note="Description of Artificial Sequence: Synthetic oligonucleotide"
ttaatgtccctgagcagttc

SEQ ID NO: 950 - DNA, 20 bp, Artificial Sequence
  source: /note="Description of Artificial Sequence: Synthetic oligonucleotide"
ccagaaggccacacagggca

SEQ ID NO: 951 - DNA, 20 bp, Artificial Sequence
  source: /note="Description of Artificial Sequence: Synthetic oligonucleotide"
tccttccagcccaaactgca

SEQ ID NO: 952 - DNA, 20 bp, Artificial Sequence
  source: /note="Description of Artificial Sequence: Synthetic oligonucleotide"
taatgtccctgagcagttct

SEQ ID NO: 953 - DNA, 20 bp, Artificial Sequence
  source: /note="Description of Artificial Sequence: Synthetic oligonucleotide"
tagaggaggcttgtgacttc

SEQ ID NO: 954 - DNA, 20 bp, Artificial Sequence
  source: /note="Description of Artificial Sequence: Synthetic oligonucleotide"
tttaatgtccctgagcagtt

SEQ ID NO: 955 - DNA, 20 bp, Artificial Sequence
  source: /note="Description of Artificial Sequence: Synthetic oligonucleotide"
ttagaggaggcttgtgactt

SEQ ID NO: 956 - DNA, 20 bp, Artificial Sequence
  source: /note="Description of Artificial Sequence: Synthetic oligonucleotide"
gtcccaggttgcccctctcc

SEQ ID NO: 957 - DNA, 20 bp, Artificial Sequence
  source: /note="Description of Artificial Sequence: Synthetic oligonucleotide"
cctcctgggagctggcctcc

SEQ ID NO: 958 - DNA, 20 bp, Artificial Sequence
  source: /note="Description of Artificial Sequence: Synthetic oligonucleotide"
ctgctcccagtctgcctgcc

SEQ ID NO: 959 - DNA, 20 bp, Artificial Sequence
  source: /note="Description of Artificial Sequence: Synthetic oligonucleotide"
gtcttgtcccaggttgcccc

SEQ ID NO: 960 - DNA, 20 bp, Artificial Sequence
  source: /note="Description of Artificial Sequence: Synthetic oligonucleotide"
tgtcccaggttgcccctctc

SEQ ID NO: 961 - DNA, 20 bp, Artificial Sequence
  source: /note="Description of Artificial Sequence: Synthetic oligonucleotide"
gctcccagtctgcctgccat

SEQ ID NO: 962 - DNA, 20 bp, Artificial Sequence
  source: /note="Description of Artificial Sequence: Synthetic oligonucleotide"
tgctcccagtctgcctgcca

SEQ ID NO: 963 - DNA, 20 bp, Artificial Sequence
  source: /note="Description of Artificial Sequence: Synthetic oligonucleotide"
ggttccccttcctcctggga

SEQ ID NO: 964 - DNA, 20 bp, Artificial Sequence
  source: /note="Description of Artificial Sequence: Synthetic oligonucleotide"
ctcctgggagctggcctcct

SEQ ID NO: 965 - DNA, 20 bp, Artificial Sequence
  source: /note="Description of Artificial Sequence: Synthetic oligonucleotide"
tcctcctgggagctggcctc

SEQ ID NO: 966 - DNA, 20 bp, Artificial Sequence
  source: /note="Description of Artificial Sequence: Synthetic oligonucleotide"
ctgggctgggcaggagccct

SEQ ID NO: 967 - DNA, 20 bp, Artificial Sequence
  source: /note="Description of Artificial Sequence: Synthetic oligonucleotide"
ggagccctgagctgcctggt

SEQ ID NO: 968 - DNA, 20 bp, Artificial Sequence
  source: /note="Description of Artificial Sequence: Synthetic oligonucleotide"
ccctctgggtgtcttgtccc

SEQ ID NO: 969 - DNA, 20 bp, Artificial Sequence
  source: /note="Description of Artificial Sequence: Synthetic oligonucleotide"
ttcctgctcccagtctgcct

SEQ ID NO: 970 - DNA, 20 bp, Artificial Sequence
  source: /note="Description of Artificial Sequence: Synthetic oligonucleotide"
ttgtcccaggttgcccctct

SEQ ID NO: 971 - DNA, 20 bp, Artificial Sequence
  source: /note="Description of Artificial Sequence: Synthetic oligonucleotide"
cttgtcccaggttgcccctc

SEQ ID NO: 972 - DNA, 20 bp, Artificial Sequence
  source: /note="Description of Artificial Sequence: Synthetic oligonucleotide"
tcttgtcccaggttgcccct

SEQ ID NO: 973 - DNA, 20 bp, Artificial Sequence
  source: /note="Description of Artificial Sequence: Synthetic oligonucleotide"
gctgggcaggagccctgagc

SEQ ID NO: 974 - DNA, 20 bp, Artificial Sequence
  source: /note="Description of Artificial Sequence: Synthetic oligonucleotide"
agcagtttccccagagcccc

SEQ ID NO: 975 - DNA, 20 bp, Artificial Sequence
  source: /note="Description of Artificial Sequence: Synthetic oligonucleotide"
gccctctgttttcctgctcc

SEQ ID NO: 976 - DNA, 20 bp, Artificial Sequence
  source: /note="Description of Artificial Sequence: Synthetic oligonucleotide"
gggccctctgttttcctgct

SEQ ID NO: 977 - DNA, 20 bp, Artificial Sequence
  source: /note="Description of Artificial Sequence: Synthetic oligonucleotide"
ttcctcctgggagctggcct

SEQ ID NO: 978 - DNA, 20 bp, Artificial Sequence
  source: /note="Description of Artificial Sequence: Synthetic oligonucleotide"
ggttgcccctctccttgcag

SEQ ID NO: 979 - DNA, 20 bp, Artificial Sequence
  source: /note="Description of Artificial Sequence: Synthetic oligonucleotide"
aggttgcccctctccttgca

SEQ ID NO: 980 - DNA, 20 bp, Artificial Sequence
  source: /note="Description of Artificial Sequence: Synthetic oligonucleotide"
caggttgcccctctccttgc

SEQ ID NO: 981 - DNA, 20 bp, Artificial Sequence
  source: /note="Description of Artificial Sequence: Synthetic oligonucleotide"
ggctgggccacaggctagct

SEQ ID NO: 982 - DNA, 20 bp, Artificial Sequence
  source: /note="Description of Artificial Sequence: Synthetic oligonucleotide"
ctgtgggttctggtgtcccc

SEQ ID NO: 983 - DNA, 20 bp, Artificial Sequence
  source: /note="Description of Artificial Sequence: Synthetic oligonucleotide"
ggccctctgttttcctgctc

SEQ ID NO: 984 - DNA, 20 bp, Artificial Sequence
  source: /note="Description of Artificial Sequence: Synthetic oligonucleotide"
tgggctgggcaggagccctg

SEQ ID NO: 985 - DNA, 20 bp, Artificial Sequence
  source: /note="Description of Artificial Sequence: Synthetic oligonucleotide"
tttcctgctcccagtctgcc

SEQ ID NO: 986 - DNA, 20 bp, Artificial Sequence
  source: /note="Description of Artificial Sequence: Synthetic oligonucleotide"
ctggaccagcccaccccagt

SEQ ID NO: 987 - DNA, 20 bp, Artificial Sequence
  source: /note="Description of Artificial Sequence: Synthetic oligonucleotide"
cccagagcccctgatctgcc

SEQ ID NO: 988 - DNA, 20 bp, Artificial Sequence
  source: /note="Description of Artificial Sequence: Synthetic oligonucleotide"
ccccagagcccctgatctgc

SEQ ID NO: 989 - DNA, 20 bp, Artificial Sequence
  source: /note="Description of Artificial Sequence: Synthetic oligonucleotide"
cctggaccagcccaccccag

SEQ ID NO: 990 - DNA, 20 bp, Artificial Sequence
  source: /note="Description of Artificial Sequence: Synthetic oligonucleotide"
ccaggttgcccctctccttg

SEQ ID NO: 991 - DNA, 20 bp, Artificial Sequence
  source: /note="Description of Artificial Sequence: Synthetic oligonucleotide"
gcccctgatctgcctggacc

SEQ ID NO: 992 - DNA, 20 bp, Artificial Sequence
  source: /note="Description of Artificial Sequence: Synthetic oligonucleotide"
gtgtcttgtcccaggttgcc

SEQ ID NO: 993 - DNA, 20 bp, Artificial Sequence
  source: /note="Description of Artificial Sequence: Synthetic oligonucleotide"
gttgcccctctccttgcaga

SEQ ID NO: 994 - DNA, 20 bp, Artificial Sequence
  source: /note="Description of Artificial Sequence: Synthetic oligonucleotide"
tgtcttgtcccaggttgccc

SEQ ID NO: 995 - DNA, 20 bp, Artificial Sequence
  source: /note="Description of Artificial Sequence: Synthetic oligonucleotide"
gcagctggaagcccagccca

SEQ ID NO: 996 - DNA, 20 bp, Artificial Sequence
  source: /note="Description of Artificial Sequence: Synthetic oligonucleotide"
atccatgccctggctctggc

SEQ ID NO: 997 - DNA, 20 bp, Artificial Sequence
  source: /note="Description of Artificial Sequence: Synthetic oligonucleotide"
cctctgggtgtcttgtccca

SEQ ID NO: 998 - DNA, 20 bp, Artificial Sequence
  source: /note="Description of Artificial Sequence: Synthetic oligonucleotide"
gcccagcccacagcaggaca

SEQ ID NO: 999 - DNA, 20 bp, Artificial Sequence
  source: /note="Description of Artificial Sequence: Synthetic oligonucleotide"
ggccttgagggttccccaca

SEQ ID NO: 1000 - DNA, 20 bp, Artificial Sequence
  source: /note="Description of Artificial Sequence: Synthetic oligonucleotide"
ccagcagtttccccagagcc

SEQ ID NO: 1001 - DNA, 20 bp, Artificial Sequence
  source: /note="Description of Artificial Sequence: Synthetic oligonucleotide"
gagccctgagctgcctggtg

SEQ ID NO: 1002 - DNA, 20 bp, Artificial Sequence
  source: /note="Description of Artificial Sequence: Synthetic oligonucleotide"
gtgttctctctcccagttcc

SEQ ID NO: 1003 - DNA, 20 bp, Artificial Sequence
  source: /note="Description of Artificial Sequence: Synthetic oligonucleotide"
ccctgagcagttcttggccc

SEQ ID NO: 1004 - DNA, 20 bp, Artificial Sequence
  source: /note="Description of Artificial Sequence: Synthetic oligonucleotide"
accctctgggtgtcttgtcc

SEQ ID NO: 1005 - DNA, 20 bp, Artificial Sequence
  source: /note="Description of Artificial Sequence: Synthetic oligonucleotide"
tacctggaccagcccacccc

SEQ ID NO: 1006 - DNA, 20 bp, Artificial Sequence
  source: /note="Description of Artificial Sequence: Synthetic oligonucleotide"
ggtgtcttgtcccaggttgc

SEQ ID NO: 1007 - DNA, 20 bp, Artificial Sequence
  source: /note="Description of Artificial Sequence: Synthetic oligonucleotide"
agtttccccagagcccctga

SEQ ID NO: 1008 - DNA, 20 bp, Artificial Sequence
  source: /note="Description of Artificial Sequence: Synthetic oligonucleotide"
ggcaccaccccatccacagc

SEQ ID NO: 1009 - DNA, 20 bp, Artificial Sequence
  source: /note="Description of Artificial Sequence: Synthetic oligonucleotide"
agcccagcccacagcaggac

SEQ ID NO: 1010 - DNA, 20 bp, Artificial Sequence
  source: /note="Description of Artificial Sequence: Synthetic oligonucleotide"
tcctccagctctcagcttct

SEQ ID NO: 1011 - DNA, 20 bp, Artificial Sequence
  source: /note="Description of Artificial Sequence: Synthetic oligonucleotide"
aggagccctgagctgcctgg

SEQ ID NO: 1012 - DNA, 20 bp, Artificial Sequence
  source: /note="Description of Artificial Sequence: Synthetic oligonucleotide"
gcctctcttcatgggcctgg

SEQ ID NO: 1013 - DNA, 20 bp, Artificial Sequence
  source: /note="Description of Artificial Sequence: Synthetic oligonucleotide"
tggctgggccacaggctagc

SEQ ID NO: 1014 - DNA, 20 bp, Artificial Sequence
  source: /note="Description of Artificial Sequence: Synthetic oligonucleotide"
ctgggtgtcttgtcccaggt

SEQ ID NO: 1015 - DNA, 20 bp, Artificial Sequence
  source: /note="Description of Artificial Sequence: Synthetic oligonucleotide"
gtttccccagagcccctgat

SEQ ID NO: 1016 - DNA, 20 bp, Artificial Sequence
  source: /note="Description of Artificial Sequence: Synthetic oligonucleotide"
aggctgtgttctctctccca

SEQ ID NO: 1017 - DNA, 20 bp, Artificial Sequence
  source: /note="Description of Artificial Sequence: Synthetic oligonucleotide"
accttctggtgccttgggct

SEQ ID NO: 1018 - DNA, 20 bp, Artificial Sequence
  source: /note="Description of Artificial Sequence: Synthetic oligonucleotide"
gctacctggaccagcccacc

SEQ ID NO: 1019 - DNA, 20 bp, Artificial Sequence
  source: /note="Description of Artificial Sequence: Synthetic oligonucleotide"
tgcagctggaagcccagccc

SEQ ID NO: 1020 - DNA, 20 bp, Artificial Sequence
  source: /note="Description of Artificial Sequence: Synthetic oligonucleotide"
ttccccagagcccctgatct

SEQ ID NO: 1021 - DNA, 20 bp, Artificial Sequence
  source: /note="Description of Artificial Sequence: Synthetic oligonucleotide"
gctatggcctacccactccc

SEQ ID NO: 1022 - DNA, 20 bp, Artificial Sequence
  source: /note="Description of Artificial Sequence: Synthetic oligonucleotide"
agcccactgtgggttctggt

SEQ ID NO: 1023 - DNA, 20 bp, Artificial Sequence
  source: /note="Description of Artificial Sequence: Synthetic oligonucleotide"
ccttctggtgccttgggctt

SEQ ID NO: 1024 - DNA, 20 bp, Artificial Sequence
  source: /note="Description of Artificial Sequence: Synthetic oligonucleotide"
gcctctgggtctttatgccc

SEQ ID NO: 1025 - DNA, 20 bp, Artificial Sequence
  source: /note="Description of Artificial Sequence: Synthetic oligonucleotide"
ctctctcccagttcccctat

SEQ ID NO: 1026 - DNA, 20 bp, Artificial Sequence
  source: /note="Description of Artificial Sequence: Synthetic oligonucleotide"
ctcccagtctgcctgccata

SEQ ID NO: 1027 - DNA, 20 bp, Artificial Sequence
  source: /note="Description of Artificial Sequence: Synthetic oligonucleotide"
tggaccagcccaccccagta

SEQ ID NO: 1028 - DNA, 20 bp, Artificial Sequence
  source: /note="Description of Artificial Sequence: Synthetic oligonucleotide"
atggcctacccactcccctg

SEQ ID NO: 1029 - DNA, 20 bp, Artificial Sequence
  source: /note="Description of Artificial Sequence: Synthetic oligonucleotide"
ccctggccctacagacctgt

SEQ ID NO: 1030 - DNA, 20 bp, Artificial Sequence
  source: /note="Description of Artificial Sequence: Synthetic oligonucleotide"
tccccagagcccctgatctg

SEQ ID NO: 1031 - DNA, 20 bp, Artificial Sequence
  source: /note="Description of Artificial Sequence: Synthetic oligonucleotide"
gcccactgtgggttctggtg

SEQ ID NO: 1032 - DNA, 20 bp, Artificial Sequence
  source: /note="Description of Artificial Sequence: Synthetic oligonucleotide"
gagcccctgatctgcctgga

SEQ ID NO: 1033 - DNA, 20 bp, Artificial Sequence
  source: /note="Description of Artificial Sequence: Synthetic oligonucleotide"
ctacctggaccagcccaccc

SEQ ID NO: 1034 - DNA, 20 bp, Artificial Sequence
  source: /note="Description of Artificial Sequence: Synthetic oligonucleotide"
gctagttgtggctgggccac

SEQ ID NO: 1035 - DNA, 20 bp, Artificial Sequence
  source: /note="Description of Artificial Sequence: Synthetic oligonucleotide"
actgtgggttctggtgtccc

SEQ ID NO: 1036 - DNA, 20 bp, Artificial Sequence
  source: /note="Description of Artificial Sequence: Synthetic oligonucleotide"
cagccccaaccaggttccca

SEQ ID NO: 1037 - DNA, 20 bp, Artificial Sequence
  source: /note="Description of Artificial Sequence: Synthetic oligonucleotide"
tccagcagtttccccagagc

SEQ ID NO: 1038 - DNA, 20 bp, Artificial Sequence
  source: /note="Description of Artificial Sequence: Synthetic oligonucleotide"
cctgagcagttcttggccct

SEQ ID NO: 1039 - DNA, 20 bp, Artificial Sequence
  source: /note="Description of Artificial Sequence: Synthetic oligonucleotide"
ggctatggcctacccactcc

SEQ ID NO: 1040 - DNA, 20 bp, Artificial Sequence
  source: /note="Description of Artificial Sequence: Synthetic oligonucleotide"
tatggcctacccactcccct

SEQ ID NO: 1041 - DNA, 20 bp, Artificial Sequence
  source: /note="Description of Artificial Sequence: Synthetic oligonucleotide"
ctatggcctacccactcccc

SEQ ID NO: 1042 - DNA, 20 bp, Artificial Sequence
  source: /note="Description of Artificial Sequence: Synthetic oligonucleotide"
tccacagctgacccagcctc

SEQ ID NO: 1043 - DNA, 20 bp, Artificial Sequence
  source: /note="Description of Artificial Sequence: Synthetic oligonucleotide"
gtccctgagcagttcttggc

SEQ ID NO: 1044 - DNA, 20 bp, Artificial Sequence
  source: /note="Description of Artificial Sequence: Synthetic oligonucleotide"
agctagttgtggctgggcca

SEQ ID NO: 1045 - DNA, 20 bp, Artificial Sequence
  source: /note="Description of Artificial Sequence: Synthetic oligonucleotide"
cagctagttgtggctgggcc

SEQ ID NO: 1046 - DNA, 20 bp, Artificial Sequence
  source: /note="Description of Artificial Sequence: Synthetic oligonucleotide"
tccctgagcagttcttggcc

SEQ ID NO: 1047 - DNA, 20 bp, Artificial Sequence
  source: /note="Description of Artificial Sequence: Synthetic oligonucleotide"
cctctgggtctttatgcccc

SEQ ID NO: 1048 - DNA, 20 bp, Artificial Sequence
  source: /note="Description of Artificial Sequence: Synthetic oligonucleotide"
caggagccctgagctgcctg

SEQ ID NO: 1049 - DNA, 20 bp, Artificial Sequence
  source: /note="Description of Artificial Sequence: Synthetic oligonucleotide"
ttttcctgctcccagtctgc

SEQ ID NO: 1050 - DNA, 20 bp, Artificial Sequence
  source: /note="Description of Artificial Sequence: Synthetic oligonucleotide"
acagccccaaccaggttccc

SEQ ID NO: 1051 - DNA, 20 bp, Artificial Sequence
  source: /note="Description of Artificial Sequence: Synthetic oligonucleotide"
gagggctggcatctctcctt

SEQ ID NO: 1052 - DNA, 20 bp, Artificial Sequence
  source: /note="Description of Artificial Sequence: Synthetic oligonucleotide"
ccctgagctgcctggtggat

SEQ ID NO: 1053 - DNA, 20 bp, Artificial Sequence
  source: /note="Description of Artificial Sequence: Synthetic oligonucleotide"
ctgcagctggaagcccagcc

SEQ ID NO: 1054 - DNA, 20 bp, Artificial Sequence
  source: /note="Description of Artificial Sequence: Synthetic oligonucleotide"
gggtgtcttgtcccaggttg

SEQ ID NO: 1055 - DNA, 20 bp, Artificial Sequence
  source: /note="Description of Artificial Sequence: Synthetic oligonucleotide"
tgggtgtcttgtcccaggtt

SEQ ID NO: 1056 - DNA, 20 bp, Artificial Sequence
  source: /note="Description of Artificial Sequence: Synthetic oligonucleotide"
agcccctgatctgcctggac

SEQ ID NO: 1057 - DNA, 20 bp, Artificial Sequence
  source: /note="Description of Artificial Sequence: Synthetic oligonucleotide"
ccccatccacagctgaccca

SEQ ID NO: 1058 - DNA, 20 bp, Artificial Sequence
  source: /note="Description of Artificial Sequence: Synthetic oligonucleotide"
gggtctttatgccccagtct

SEQ ID NO: 1059 - DNA, 20 bp, Artificial Sequence
  source: /note="Description of Artificial Sequence: Synthetic oligonucleotide"
tttccccagagcccctgatc

SEQ ID NO: 1060 - DNA, 20 bp, Artificial Sequence
  source: /note="Description of Artificial Sequence: Synthetic oligonucleotide"
gccaggcctaggtgcttgac

SEQ ID NO: 1061 - DNA, 20 bp, Artificial Sequence
  source: /note="Description of Artificial Sequence: Synthetic oligonucleotide"
cccactgtgggttctggtgt

SEQ ID NO: 1062 - DNA, 20 bp, Artificial Sequence
  source: /note="Description of Artificial Sequence: Synthetic oligonucleotide"
tcccagtctgcctgccatac

SEQ ID NO: 1063 - DNA, 20 bp, Artificial Sequence
  source: /note="Description of Artificial Sequence: Synthetic oligonucleotide"
cccctgatctgcctggacca

SEQ ID NO: 1064 - DNA, 20 bp, Artificial Sequence
  source: /note="Description of Artificial Sequence: Synthetic oligonucleotide"
tctgggtgtcttgtcccagg

SEQ ID NO: 1065 - DNA, 20 bp, Artificial Sequence
  source: /note="Description of Artificial Sequence: Synthetic oligonucleotide"
tcctgctctgtatggcctct

SEQ ID NO: 1066 - DNA, 20 bp, Artificial Sequence
  source: /note="Description of Artificial Sequence: Synthetic oligonucleotide"
gccttgagggttccccacat

SEQ ID NO: 1067 - DNA, 20 bp, Artificial Sequence
  source: /note="Description of Artificial Sequence: Synthetic oligonucleotide"
gtcagttctccctttctgct

SEQ ID NO: 1068 - DNA, 20 bp, Artificial Sequence
  source: /note="Description of Artificial Sequence: Synthetic oligonucleotide"
gggctggtttgcctcaaccc

SEQ ID NO: 1069 - DNA, 20 bp, Artificial Sequence
  source: /note="Description of Artificial Sequence: Synthetic oligonucleotide"
agagcccctgatctgcctgg

SEQ ID NO: 1070 - DNA, 20 bp, Artificial Sequence
  source: /note="Description of Artificial Sequence: Synthetic oligonucleotide"
gagttccagcagtttcccca

SEQ ID NO: 1071 - DNA, 20 bp, Artificial Sequence
  source: /note="Description of Artificial Sequence: Synthetic oligonucleotide"
ggtctgcagctggaagccca

SEQ ID NO: 1072 - DNA, 20 bp, Artificial Sequence
  source: /note="Description of Artificial Sequence: Synthetic oligonucleotide"
tctctcccagttcccctatt

SEQ ID NO: 1073 - DNA, 20 bp, Artificial Sequence
  source: /note="Description of Artificial Sequence: Synthetic oligonucleotide"
agccaggcctaggtgcttga

SEQ ID NO: 1074 - DNA, 20 bp, Artificial Sequence
  source: /note="Description of Artificial Sequence: Synthetic oligonucleotide"
gtacctggttagtgccagcc

SEQ ID NO: 1075 - DNA, 20 bp, Artificial Sequence
  source: /note="Description of Artificial Sequence: Synthetic oligonucleotide"
aggcccactgcaggacaggt

SEQ ID NO: 1076 - DNA, 20 bp, Artificial Sequence
  source: /note="Description of Artificial Sequence: Synthetic oligonucleotide"
gacaggccttgagggttccc

SEQ ID NO: 1077 - DNA, 20 bp, Artificial Sequence
  source: /note="Description of Artificial Sequence: Synthetic oligonucleotide"
gatctggctgactcagcccc

SEQ ID NO: 1078 - DNA, 20 bp, Artificial Sequence
  source: /note="Description of Artificial Sequence: Synthetic oligonucleotide"
ggttagtgccagccttggga

SEQ ID NO: 1079 - DNA, 20 bp, Artificial Sequence
  source: /note="Description of Artificial Sequence: Synthetic oligonucleotide"
gcctaggtgcttgacctggt

SEQ ID NO: 1080 - DNA, 20 bp, Artificial Sequence
  source: /note="Description of Artificial Sequence: Synthetic oligonucleotide"
gttttcctgctcccagtctg

SEQ ID NO: 1081 - DNA, 20 bp, Artificial Sequence
  source: /note="Description of Artificial Sequence: Synthetic oligonucleotide"
tgttttcctgctcccagtct

SEQ ID NO: 1082 - DNA, 20 bp, Artificial Sequence
  source: /note="Description of Artificial Sequence: Synthetic oligonucleotide"
ctgttttcctgctcccagtc

SEQ ID NO: 1083 - DNA, 20 bp, Artificial Sequence
  source: /note="Description of Artificial Sequence: Synthetic oligonucleotide"
tctgttttcctgctcccagt

SEQ ID NO: 1084 - DNA, 20 bp, Artificial Sequence
  source: /note="Description of Artificial Sequence: Synthetic oligonucleotide"
agcagttcttggcccttggg

SEQ ID NO: 1085 - DNA, 20 bp, Artificial Sequence
  source: /note="Description of Artificial Sequence: Synthetic oligonucleotide"
caccctggccctacagacct

SEQ ID NO: 1086 - DNA, 20 bp, Artificial Sequence
  source: /note="Description of Artificial Sequence: Synthetic oligonucleotide"
acccacacaggcccactgca

SEQ ID NO: 1087 - DNA, 20 bp, Artificial Sequence
  source: /note="Description of Artificial Sequence: Synthetic oligonucleotide"
gagctacctggaccagccca

SEQ ID NO: 1088 - DNA, 20 bp, Artificial Sequence
  source: /note="Description of Artificial Sequence: Synthetic oligonucleotide"
attgtcctccagctctcagc

SEQ ID NO: 1089 - DNA, 20 bp, Artificial Sequence
  source: /note="Description of Artificial Sequence: Synthetic oligonucleotide"
ggccctacagacctgtgtct

SEQ ID NO: 1090 - DNA, 20 bp, Artificial Sequence
  source: /note="Description of Artificial Sequence: Synthetic oligonucleotide"
gccacaggctagcttgaccc

SEQ ID NO: 1091 - DNA, 20 bp, Artificial Sequence
  source: /note="Description of Artificial Sequence: Synthetic oligonucleotide"
ggctggtttgcctcaaccct

SEQ ID NO: 1092 - DNA, 20 bp, Artificial Sequence
  source: /note="Description of Artificial Sequence: Synthetic oligonucleotide"
ctctgggtgtcttgtcccag

SEQ ID NO: 1093 - DNA, 20 bp, Artificial Sequence
  source: /note="Description of Artificial Sequence: Synthetic oligonucleotide"
acagcttctccagcctctgg

SEQ ID NO: 1094 - DNA, 20 bp, Artificial Sequence
  source: /note="Description of Artificial Sequence: Synthetic oligonucleotide"
tccagagccatgtccctgga

SEQ ID NO: 1095 - DNA, 20 bp, Artificial Sequence
  source: /note="Description of Artificial Sequence: Synthetic oligonucleotide"
atgcctctcttcatgggcct

SEQ ID NO: 1096 - DNA, 20 bp, Artificial Sequence
  source: /note="Description of Artificial Sequence: Synthetic oligonucleotide"
tccttggctatggcctaccc

SEQ ID NO: 1097 - DNA, 20 bp, Artificial Sequence
  source: /note="Description of Artificial Sequence: Synthetic oligonucleotide"
ggcccactgcaggacaggtg

SEQ ID NO: 1098 - DNA, 20 bp, Artificial Sequence
  source: /note="Description of Artificial Sequence: Synthetic oligonucleotide"
ccaggcctaggtgcttgacc

SEQ ID NO: 1099 - DNA, 20 bp, Artificial Sequence
  source: /note="Description of Artificial Sequence: Synthetic oligonucleotide"
ctggtgccttgggctttggg

SEQ ID NO: 1100 - DNA, 20 bp, Artificial Sequence
  source: /note="Description of Artificial Sequence: Synthetic oligonucleotide"
acctggttagtgccagcctt

SEQ ID NO: 1101 - DNA, 20 bp, Artificial Sequence
  source: /note="Description of Artificial Sequence: Synthetic oligonucleotide"
tgcctctcttcatgggcctg

SEQ ID NO: 1102 - DNA, 20 bp, Artificial Sequence
  source: /note="Description of Artificial Sequence: Synthetic oligonucleotide"
aagctgctgggctgggcagg

SEQ ID NO: 1103 - DNA, 20 bp, Artificial Sequence
  source: /note="Description of Artificial Sequence: Synthetic oligonucleotide"
gccacttctgagtcctctgt

SEQ ID NO: 1104 - DNA, 20 bp, Artificial Sequence
  source: /note="Description of Artificial Sequence: Synthetic oligonucleotide"
ggaccagcccaccccagtaa

SEQ ID NO: 1105 - DNA, 20 bp, Artificial Sequence
  source: /note="Description of Artificial Sequence: Synthetic oligonucleotide"
gctctcttttctgctgtggc

SEQ ID NO: 1106 - DNA, 20 bp, Artificial Sequence
  source: /note="Description of Artificial Sequence: Synthetic oligonucleotide"
tcccctggctgaagagtgcc

SEQ ID NO: 1107 - DNA, 20 bp, Artificial Sequence
  source: /note="Description of Artificial Sequence: Synthetic oligonucleotide"
agttgtggctgggccacagg

SEQ ID NO: 1108 - DNA, 20 bp, Artificial Sequence
  source: /note="Description of Artificial Sequence: Synthetic oligonucleotide"
tcctcttctcctcccaacca

SEQ ID NO: 1109 - DNA, 20 bp, Artificial Sequence
  source: /note="Description of Artificial Sequence: Synthetic oligonucleotide"
aagcccagcccacagcagga

SEQ ID NO: 1110 - DNA, 20 bp, Artificial Sequence
  source: /note="Description of Artificial Sequence: Synthetic oligonucleotide"
gaagcccagcccacagcagg

SEQ ID NO: 1111 - DNA, 20 bp, Artificial Sequence
  source: /note="Description of Artificial Sequence: Synthetic oligonucleotide"
tgcccctctccttgcagatg

SEQ ID NO: 1112 - DNA, 20 bp, Artificial Sequence
  source: /note="Description of Artificial Sequence: Synthetic oligonucleotide"
agttccagcagtttccccag

SEQ ID NO: 1113 - DNA, 20 bp, Artificial Sequence
  source: /note="Description of Artificial Sequence: Synthetic oligonucleotide"
gcacagccccaaccaggttc

SEQ ID NO: 1114 - DNA, 20 bp, Artificial Sequence
  source: /note="Description of Artificial Sequence: Synthetic oligonucleotide"
gacccagcctctgtctagga

SEQ ID NO: 1115 - DNA, 20 bp, Artificial Sequence
  source: /note="Description of Artificial Sequence: Synthetic oligonucleotide"
ggtacctggttagtgccagc

SEQ ID NO: 1116 - DNA, 20 bp, Artificial Sequence
  source: /note="Description of Artificial Sequence: Synthetic oligonucleotide"
ggatctggctgactcagccc

SEQ ID NO: 1117 - DNA, 20 bp, Artificial Sequence
  source: /note="Description of Artificial Sequence: Synthetic oligonucleotide"
ctccagcctctgggtcttta

SEQ ID NO: 1118 - DNA, 20 bp, Artificial Sequence
  source: /note="Description of Artificial Sequence: Synthetic oligonucleotide"
ggccttggcttagaggaggc

SEQ ID NO: 1119 - DNA, 20 bp, Artificial Sequence
  source: /note="Description of Artificial Sequence: Synthetic oligonucleotide"
agctacctggaccagcccac

SEQ ID NO: 1120 - DNA, 20 bp, Artificial Sequence
  source: /note="Description of Artificial Sequence: Synthetic oligonucleotide"
agagctacctggaccagccc

SEQ ID NO: 1121 - DNA, 20 bp, Artificial Sequence
  source: /note="Description of Artificial Sequence: Synthetic oligonucleotide"
tcagctagttgtggctgggc

SEQ ID NO: 1122 - DNA, 20 bp, Artificial Sequence
  source: /note="Description of Artificial Sequence: Synthetic oligonucleotide"
gggttctggtgtccccagaa

SEQ ID NO: 1123 - DNA, 20 bp, Artificial Sequence
  source: /note="Description of Artificial Sequence: Synthetic oligonucleotide"
ggcctaggtgcttgacctgg

SEQ ID NO: 1124 - DNA, 20 bp, Artificial Sequence
  source: /note="Description of Artificial Sequence: Synthetic oligonucleotide"
cccagcctctgtctaggatc

SEQ ID NO: 1125 - DNA, 20 bp, Artificial Sequence
  source: /note="Description of Artificial Sequence: Synthetic oligonucleotide"
ccttggctatggcctaccca

SEQ ID NO: 1126 - DNA, 20 bp, Artificial Sequence
  source: /note="Description of Artificial Sequence: Synthetic oligonucleotide"
gctggtttgcctcaaccctc

SEQ ID NO: 1127 - DNA, 20 bp, Artificial Sequence
  source: /note="Description of Artificial Sequence: Synthetic oligonucleotide"
ctgcacagccccaaccaggt

SEQ ID NO: 1128 - DNA, 20 bp, Artificial Sequence
  source: /note="Description of Artificial Sequence: Synthetic oligonucleotide"
ggccacaggctagcttgacc

SEQ ID NO: 1129 - DNA, 20 bp, Artificial Sequence
  source: /note="Description of Artificial Sequence: Synthetic oligonucleotide"
ctgcagcccagccaagcaga

SEQ ID NO: 1130 - DNA, 20 bp, Artificial Sequence
  source: /note="Description of Artificial Sequence: Synthetic oligonucleotide"
caggccagaggagaggtcct

SEQ ID NO: 1131 - DNA, 20 bp, Artificial Sequence
  source: /note="Description of Artificial Sequence: Synthetic oligonucleotide"
ttcctgctctgtatggcctc

SEQ ID NO: 1132 - DNA, 20 bp, Artificial Sequence
  source: /note="Description of Artificial Sequence: Synthetic oligonucleotide"
aggcaccaccccatccacag

SEQ ID NO: 1133 - DNA, 20 bp, Artificial Sequence
  source: /note="Description of Artificial Sequence: Synthetic oligonucleotide"
tctggtgccttgggctttgg

SEQ ID NO: 1134 - DNA, 20 bp, Artificial Sequence
  source: /note="Description of Artificial Sequence: Synthetic oligonucleotide"
cccctggctgaagagtgcca

SEQ ID NO: 1135 - DNA, 20 bp, Artificial Sequence
  source: /note="Description of Artificial Sequence: Synthetic oligonucleotide"
accctggccctacagacctg

SEQ ID NO: 1136 - DNA, 20 bp, Artificial Sequence
  source: /note="Description of Artificial Sequence: Synthetic oligonucleotide"
ccacacaggcccactgcagg

SEQ ID NO: 1137 - DNA, 20 bp, Artificial Sequence
  source: /note="Description of Artificial Sequence: Synthetic oligonucleotide"
cttctggtgccttgggcttt

SEQ ID NO: 1138 - DNA, 20 bp, Artificial Sequence
  source: /note="Description of Artificial Sequence: Synthetic oligonucleotide"
tacctggttagtgccagcct

SEQ ID NO: 1139 - DNA, 20 bp, Artificial Sequence
  source: /note="Description of Artificial Sequence: Synthetic oligonucleotide"
cagagcccactgtgggttct

SEQ ID NO: 1140 - DNA, 20 bp, Artificial Sequence
  source: /note="Description of Artificial Sequence: Synthetic oligonucleotide"
gagcagttcttggcccttgg

SEQ ID NO: 1141 - DNA, 20 bp, Artificial Sequence
  source: /note="Description of Artificial Sequence: Synthetic oligonucleotide"
agtcagttctccctttctgc

SEQ ID NO: 1142 - DNA, 20 bp, Artificial Sequence
  source: /note="Description of Artificial Sequence: Synthetic oligonucleotide"
cactgtgggttctggtgtcc

SEQ ID NO: 1143 - DNA, 20 bp, Artificial Sequence
  source: /note="Description of Artificial Sequence: Synthetic oligonucleotide"
ctgggtctttatgccccagt

SEQ ID NO: 1144 - DNA, 20 bp, Artificial Sequence
  source: /note="Description of Artificial Sequence: Synthetic oligonucleotide"
ggccagaggagaggtcctga

SEQ ID NO: 1145 - DNA, 20 bp, Artificial Sequence
  source: /note="Description of Artificial Sequence: Synthetic oligonucleotide"
tctcttttctgctgtggcct

SEQ ID NO: 1146 - DNA, 20 bp, Artificial Sequence
  source: /note="Description of Artificial Sequence: Synthetic oligonucleotide"
ctctcttttctgctgtggcc

SEQ ID NO: 1147 - DNA, 20 bp, Artificial Sequence
  source: /note="Description of Artificial Sequence: Synthetic oligonucleotide"
agcctctgggtctttatgcc

SEQ ID NO: 1148 - DNA, 20 bp, Artificial Sequence
  source: /note="Description of Artificial Sequence: Synthetic oligonucleotide"
tgtgttctctctcccagttc

SEQ ID NO: 1149 - DNA, 20 bp, Artificial Sequence
  source: /note="Description of Artificial Sequence: Synthetic oligonucleotide"
ggccacttctgagtcctctg

SEQ ID NO: 1150 - DNA, 20 bp, Artificial Sequence
  source: /note="Description of Artificial Sequence: Synthetic oligonucleotide"
gtcatatccatgccctggct

SEQ ID NO: 1151 - DNA, 20 bp, Artificial Sequence
  source: /note="Description of Artificial Sequence: Synthetic oligonucleotide"
gtttcctcttctcctcccaa

SEQ ID NO: 1152 - DNA, 20 bp, Artificial Sequence
  source: /note="Description of Artificial Sequence: Synthetic oligonucleotide"
cacagccccaaccaggttcc

SEQ ID NO: 1153 - DNA, 20 bp, Artificial Sequence
  source: /note="Description of Artificial Sequence: Synthetic oligonucleotide"
ggtgctctcttttctgctgt

SEQ ID NO: 1154 - DNA, 20 bp, Artificial Sequence
  source: /note="Description of Artificial Sequence: Synthetic oligonucleotide"
tggttagtgccagccttggg

SEQ ID NO: 1155 - DNA, 20 bp, Artificial Sequence
  source: /note="Description of Artificial Sequence: Synthetic oligonucleotide"
gcctaatcctccaggagcca

SEQ ID NO: 1156 - DNA, 20 bp, Artificial Sequence
  source: /note="Description of Artificial Sequence: Synthetic oligonucleotide"
tcccagcactttctctgtgc

SEQ ID NO: 1157 - DNA, 20 bp, Artificial Sequence
  source: /note="Description of Artificial Sequence: Synthetic oligonucleotide"
ctctgggtctttatgcccca

SEQ ID NO: 1158 - DNA, 20 bp, Artificial Sequence
  source: /note="Description of Artificial Sequence: Synthetic oligonucleotide"
accaaggcaccaccccatcc

SEQ ID NO: 1159 - DNA, 20 bp, Artificial Sequence
  source: /note="Description of Artificial Sequence: Synthetic oligonucleotide"
tgggtctttatgccccagtc

SEQ ID NO: 1160 - DNA, 20 bp, Artificial Sequence
  source: /note="Description of Artificial Sequence: Synthetic oligonucleotide"
cctgctctgtatggcctctg

SEQ ID NO: 1161 - DNA, 20 bp, Artificial Sequence
  source: /note="Description of Artificial Sequence: Synthetic oligonucleotide"
tatccatgccctggctctgg

SEQ ID NO: 1162 - DNA, 20 bp, Artificial Sequence
  source: /note="Description of Artificial Sequence: Synthetic oligonucleotide"
ggagtcagttctccctttct

SEQ ID NO: 1163 - DNA, 20 bp, Artificial Sequence
  source: /note="Description of Artificial Sequence: Synthetic oligonucleotide"
taccctctgggtgtcttgtc

SEQ ID NO: 1164 - DNA, 20 bp, Artificial Sequence
  source: /note="Description of Artificial Sequence: Synthetic oligonucleotide"
gtatgggtggcagtcacctc

SEQ ID NO: 1165 - DNA, 20 bp, Artificial Sequence
  source: /note="Description of Artificial Sequence: Synthetic oligonucleotide"
gaagctgctgggctgggcag

SEQ ID NO: 1166 - DNA, 20 bp, Artificial Sequence
  source: /note="Description of Artificial Sequence: Synthetic oligonucleotide"
agaagctgctgggctgggca

SEQ ID NO: 1167 - DNA, 20 bp, Artificial Sequence
  source: /note="Description of Artificial Sequence: Synthetic oligonucleotide"
gttctccctttctgctatcc

SEQ ID NO: 1168 - DNA, 20 bp, Artificial Sequence
  source: /note="Description of Artificial Sequence: Synthetic oligonucleotide"
aaggctgtgttctctctccc

SEQ ID NO: 1169 - DNA, 20 bp, Artificial Sequence
  source: /note="Description of Artificial Sequence: Synthetic oligonucleotide"
gtccctggatattgtcctcc

SEQ ID NO: 1170 - DNA, 20 bp, Artificial Sequence
  source: /note="Description of Artificial Sequence: Synthetic oligonucleotide"
gccccaaccaggttcccaac

SEQ ID NO: 1171 - DNA, 20 bp, Artificial Sequence
  source: /note="Description of Artificial Sequence: Synthetic oligonucleotide"
gtcagctagttgtggctggg

SEQ ID NO: 1172 - DNA, 20 bp, Artificial Sequence
  source: /note="Description of Artificial Sequence: Synthetic oligonucleotide"
tcttttctgctgtggcctgt

SEQ ID NO: 1173 - DNA, 20 bp, Artificial Sequence
  source: /note="Description of Artificial Sequence: Synthetic oligonucleotide"
gtctcaggagaagccaggcc

SEQ ID NO: 1174 - DNA, 20 bp, Artificial Sequence
  source: /note="Description of Artificial Sequence: Synthetic oligonucleotide"
gagctgcctggtggattggt

SEQ ID NO: 1175 - DNA, 20 bp, Artificial Sequence
  source: /note="Description of Artificial Sequence: Synthetic oligonucleotide"
accccacaggccagaggaga

SEQ ID NO: 1176 - DNA, 20 bp, Artificial Sequence
  source: /note="Description of Artificial Sequence: Synthetic oligonucleotide"
tgctctgtatggcctctggg

SEQ ID NO: 1177 - DNA, 20 bp, Artificial Sequence
  source: /note="Description of Artificial Sequence: Synthetic oligonucleotide"
gtcacttctccagacaggcc

SEQ ID NO: 1178 - DNA, 20 bp, Artificial Sequence
  source: /note="Description of Artificial Sequence: Synthetic oligonucleotide"
cctcttctcctcccaaccag

SEQ ID NO: 1179 - DNA, 20 bp, Artificial Sequence
  source: /note="Description of Artificial Sequence: Synthetic oligonucleotide"
gtcctagtatgggtggcagt

SEQ ID NO: 1180 - DNA, 20 bp, Artificial Sequence
  source: /note="Description of Artificial Sequence: Synthetic oligonucleotide"
caggcctaggtgcttgacct

SEQ ID NO: 1181 - DNA, 20 bp, Artificial Sequence
  source: /note="Description of Artificial Sequence: Synthetic oligonucleotide"
ccagagccatgtccctggat

SEQ ID NO: 1182 - DNA, 20 bp, Artificial Sequence
  source: /note="Description of Artificial Sequence: Synthetic oligonucleotide"
ctgagcagttcttggccctt

SEQ ID NO: 1183 - DNA, 20 bp, Artificial Sequence
  source: /note="Description of Artificial Sequence: Synthetic oligonucleotide"
cctggccctacagacctgtg

SEQ ID NO: 1184 - DNA, 20 bp, Artificial Sequence
  source: /note="Description of Artificial Sequence: Synthetic oligonucleotide"
ggctgcctaatcctccagga

SEQ ID NO: 1185 - DNA, 20 bp, Artificial Sequence
  source: /note="Description of Artificial Sequence: Synthetic oligonucleotide"
agccccaaccaggttcccaa

SEQ ID NO: 1186 - DNA, 20 bp, Artificial Sequence
  source: /note="Description of Artificial Sequence: Synthetic oligonucleotide"
ctcccctggctgaagagtgc

SEQ ID NO: 1187 - DNA, 20 bp, Artificial Sequence
  source: /note="Description of Artificial Sequence: Synthetic oligonucleotide"
acccagcctctgtctaggat

SEQ ID NO: 1188 - DNA, 20 bp, Artificial Sequence
  source: /note="Description of Artificial Sequence: Synthetic oligonucleotide"
gggccacaggctagcttgac

SEQ ID NO: 1189 - DNA, 20 bp, Artificial Sequence
  source: /note="Description of Artificial Sequence: Synthetic oligonucleotide"
gtgttgcctttgctgtggtt

SEQ ID NO: 1190 - DNA, 20 bp, Artificial Sequence
  source: /note="Description of Artificial Sequence: Synthetic oligonucleotide"
gaagccaggcctaggtgctt

SEQ ID NO: 1191 - DNA, 20 bp, Artificial Sequence
  source: /note="Description of Artificial Sequence: Synthetic oligonucleotide"
ctggccctacagacctgtgt

SEQ ID NO: 1192 - DNA, 20 bp, Artificial Sequence
  source: /note="Description of Artificial Sequence: Synthetic oligonucleotide"
ctagttgtggctgggccaca

SEQ ID NO: 1193 - DNA, 20 bp, Artificial Sequence
  source: /note="Description of Artificial Sequence: Synthetic oligonucleotide"
ccccacaggccagaggagag

SEQ ID NO: 1194 - DNA, 20 bp, Artificial Sequence
  source: /note="Description of Artificial Sequence: Synthetic oligonucleotide"
caggcccactgcaggacagg

SEQ ID NO: 1195 - DNA, 20 bp, Artificial Sequence
  source: /note="Description of Artificial Sequence: Synthetic oligonucleotide"
gtggtacctggttagtgcca

SEQ ID NO: 1196 - DNA, 20 bp, Artificial Sequence
  source: /note="Description of Artificial Sequence: Synthetic oligonucleotide"
agaagccaggcctaggtgct

SEQ ID NO: 1197 - DNA, 20 bp, Artificial Sequence
  source: /note="Description of Artificial Sequence: Synthetic oligonucleotide"
gccagccttgggaaggaggg

SEQ ID NO: 1198 - DNA, 20 bp, Artificial Sequence
  source: /note="Description of Artificial Sequence: Synthetic oligonucleotide"
aagtttcctcttctcctccc

SEQ ID NO: 1199 - DNA, 20 bp, Artificial Sequence
  source: /note="Description of Artificial Sequence: Synthetic oligonucleotide"
tgacccagcctctgtctagg

SEQ ID NO: 1200 - DNA, 20 bp, Artificial Sequence
  source: /note="Description of Artificial Sequence: Synthetic oligonucleotide"
gtctttatgccccagtctgg

SEQ ID NO: 1201 - DNA, 20 bp, Artificial Sequence
  source: /note="Description of Artificial Sequence: Synthetic oligonucleotide"
ggtctttatgccccagtctg

SEQ ID NO: 1202 - DNA, 20 bp, Artificial Sequence
  source: /note="Description of Artificial Sequence: Synthetic oligonucleotide"
tggccctacagacctgtgtc

SEQ ID NO: 1203 - DNA, 20 bp, Artificial Sequence
  source: /note="Description of Artificial Sequence: Synthetic oligonucleotide"
gggcagtgctctctttggac

SEQ ID NO: 1204 - DNA, 20 bp, Artificial Sequence
  source: /note="Description of Artificial Sequence: Synthetic oligonucleotide"
ggtgccatacagagcccact

SEQ ID NO: 1205 - DNA, 20 bp, Artificial Sequence
  source: /note="Description of Artificial Sequence: Synthetic oligonucleotide"
tccagacaggccttgagggt

SEQ ID NO: 1206 - DNA, 20 bp, Artificial Sequence
  source: /note="Description of Artificial Sequence: Synthetic oligonucleotide"
aaccttctggtgccttgggc

SEQ ID NO: 1207 - DNA, 20 bp, Artificial Sequence
  source: /note="Description of Artificial Sequence: Synthetic oligonucleotide"
cctgagctgcctggtggatt

SEQ ID NO: 1208 - DNA, 20 bp, Artificial Sequence
  source: /note="Description of Artificial Sequence: Synthetic oligonucleotide"
aggccagaggagaggtcctg

SEQ ID NO: 1209 - DNA, 20 bp, Artificial Sequence
  source: /note="Description of Artificial Sequence: Synthetic oligonucleotide"
tggctatggcctacccactc

SEQ ID NO: 1210 - DNA, 20 bp, Artificial Sequence
  source: /note="Description of Artificial Sequence: Synthetic oligonucleotide"
tctggtgccatacagagccc

SEQ ID NO: 1211 - DNA, 20 bp, Artificial Sequence
  source: /note="Description of Artificial Sequence: Synthetic oligonucleotide"
tgcacagccccaaccaggtt

SEQ ID NO: 1212 - DNA, 20 bp, Artificial Sequence
  source: /note="Description of Artificial Sequence: Synthetic oligonucleotide"
tctggctgactcagccccaa

SEQ ID NO: 1213 - DNA, 20 bp, Artificial Sequence
  source: /note="Description of Artificial Sequence: Synthetic oligonucleotide"
tcactctacccagccactct

SEQ ID NO: 1214 - DNA, 20 bp, Artificial Sequence
  source: /note="Description of Artificial Sequence: Synthetic oligonucleotide"
acaggccagaggagaggtcc

SEQ ID NO: 1215 - DNA, 20 bp, Artificial Sequence
  source: /note="Description of Artificial Sequence: Synthetic oligonucleotide"
ctgctctgtatggcctctgg

SEQ ID NO: 1216 - DNA, 20 bp, Artificial Sequence
  source: /note="Description of Artificial Sequence: Synthetic oligonucleotide"
ccagcctctgtctaggatct

SEQ ID NO: 1217 - DNA, 20 bp, Artificial Sequence
  source: /note="Description of Artificial Sequence: Synthetic oligonucleotide"
ggacctcaggagggagtggg

SEQ ID NO: 1218 - DNA, 20 bp, Artificial Sequence
  source: /note="Description of Artificial Sequence: Synthetic oligonucleotide"
agagcccactgtgggttctg

SEQ ID NO: 1219 - DNA, 20 bp, Artificial Sequence
  source: /note="Description of Artificial Sequence: Synthetic oligonucleotide"
agggcagtgctctctttgga

SEQ ID NO: 1220 - DNA, 20 bp, Artificial Sequence
  source: /note="Description of Artificial Sequence: Synthetic oligonucleotide"
tgcctaatcctccaggagcc

SEQ ID NO: 1221 - DNA, 20 bp, Artificial Sequence
  source: /note="Description of Artificial Sequence: Synthetic oligonucleotide"
acagagcccactgtgggttc

SEQ ID NO: 1222 - DNA, 20 bp, Artificial Sequence
  source: /note="Description of Artificial Sequence: Synthetic oligonucleotide"
agggctggtttgcctcaacc

SEQ ID NO: 1223 - DNA, 20 bp, Artificial Sequence
  source: /note="Description of Artificial Sequence: Synthetic oligonucleotide"
ccactgcaggacaggtggca

SEQ ID NO: 1224 - DNA, 20 bp, Artificial Sequence
  source: /note="Description of Artificial Sequence: Synthetic oligonucleotide"
gagaagccaggcctaggtgc

SEQ ID NO: 1225 - DNA, 20 bp, Artificial Sequence
  source: /note="Description of Artificial Sequence: Synthetic oligonucleotide"
tacccactcccctggctgaa

SEQ ID NO: 1226 - DNA, 20 bp, Artificial Sequence
  source: /note="Description of Artificial Sequence: Synthetic oligonucleotide"
ttttccagagccatgtccct

SEQ ID NO: 1227 - DNA, 20 bp, Artificial Sequence
  source: /note="Description of Artificial Sequence: Synthetic oligonucleotide"
ttccagcagtttccccagag

SEQ ID NO: 1228 - DNA, 20 bp, Artificial Sequence
  source: /note="Description of Artificial Sequence: Synthetic oligonucleotide"
tccagcctctgggtctttat

SEQ ID NO: 1229 - DNA, 20 bp, Artificial Sequence
  source: /note="Description of Artificial Sequence: Synthetic oligonucleotide"
gacaggagtcagttctccct

SEQ ID NO: 1230 - DNA, 20 bp, Artificial Sequence
  source: /note="Description of Artificial Sequence: Synthetic oligonucleotide"
tgggccacaggctagcttga

SEQ ID NO: 1231 - DNA, 20 bp, Artificial Sequence
  source: /note="Description of Artificial Sequence: Synthetic oligonucleotide"
atgggtggcagtcacctctg

SEQ ID NO: 1232 - DNA, 20 bp, Artificial Sequence
  source: /note="Description of Artificial Sequence: Synthetic oligonucleotide"
catatccatgccctggctct

SEQ ID NO: 1233 - DNA, 20 bp, Artificial Sequence
  source: /note="Description of Artificial Sequence: Synthetic oligonucleotide"
ggagggctggtttgcctcaa

SEQ ID NO: 1234 - DNA, 20 bp, Artificial Sequence
  source: /note="Description of Artificial Sequence: Synthetic oligonucleotide"
gccctacagacctgtgtctg

SEQ ID NO: 1235 - DNA, 20 bp, Artificial Sequence
  source: /note="Description of Artificial Sequence: Synthetic oligonucleotide"
gttgcctttgctgtggttgg

SEQ ID NO: 1236 - DNA, 20 bp, Artificial Sequence
  source: /note="Description of Artificial Sequence: Synthetic oligonucleotide"
attcctgctctgtatggcct

SEQ ID NO: 1237 - DNA, 20 bp, Artificial Sequence
  source: /note="Description of Artificial Sequence: Synthetic oligonucleotide"
cccacaggccagaggagagg

SEQ ID NO: 1238 - DNA, 20 bp, Artificial Sequence
  source: /note="Description of Artificial Sequence: Synthetic oligonucleotide"
agacaggccttgagggttcc

SEQ ID NO: 1239 - DNA, 20 bp, Artificial Sequence
  source: /note="Description of Artificial Sequence: Synthetic oligonucleotide"
ctggtgccatacagagccca

SEQ ID NO: 1240 - DNA, 20 bp, Artificial Sequence
  source: /note="Description of Artificial Sequence: Synthetic oligonucleotide"
gggcagaggatcatgccacc

SEQ ID NO: 1241 - DNA, 20 bp, Artificial Sequence
  source: /note="Description of Artificial Sequence: Synthetic oligonucleotide"
tctgggtctttatgccccag

SEQ ID NO: 1242 - DNA, 20 bp, Artificial Sequence
  source: /note="Description of Artificial Sequence: Synthetic oligonucleotide"
ttaccctctgggtgtcttgt

SEQ ID NO: 1243 - DNA, 20 bp, Artificial Sequence
  source: /note="Description of Artificial Sequence: Synthetic oligonucleotide"
gtctaagggcagtgctctct

SEQ ID NO: 1244 - DNA, 20 bp, Artificial Sequence
  source: /note="Description of Artificial Sequence: Synthetic oligonucleotide"
tcatatccatgccctggctc

SEQ ID NO: 1245 - DNA, 20 bp, Artificial Sequence
  source: /note="Description of Artificial Sequence: Synthetic oligonucleotide"
aggcctaggtgcttgacctg

SEQ ID NO: 1246 - DNA, 20 bp, Artificial Sequence
  source: /note="Description of Artificial Sequence: Synthetic oligonucleotide"
agtatgggtggcagtcacct

SEQ ID NO: 1247 - DNA, 20 bp, Artificial Sequence
  source: /note="Description of Artificial Sequence: Synthetic oligonucleotide"
tctgagtcctctgtctcagg

SEQ ID NO: 1248 - DNA, 20 bp, Artificial Sequence
  source: /note="Description of Artificial Sequence: Synthetic oligonucleotide"
agacctgtgtctgagcaggc

SEQ ID NO: 1249 - DNA, 20 bp, Artificial Sequence
  source: /note="Description of Artificial Sequence: Synthetic oligonucleotide"
cctcaggagggagtgggact

SEQ ID NO: 1250 - DNA, 20 bp, Artificial Sequence
  source: /note="Description of Artificial Sequence: Synthetic oligonucleotide"
tatgggtggcagtcacctct

SEQ ID NO: 1251 - DNA, 20 bp, Artificial Sequence
  source: /note="Description of Artificial Sequence: Synthetic oligonucleotide"
gcagtcatcagccattcctt

SEQ ID NO: 1252 - DNA, 20 bp, Artificial Sequence
  source: /note="Description of Artificial Sequence: Synthetic oligonucleotide"
cacaggcccactgcaggaca

SEQ ID NO: 1253 - DNA, 20 bp, Artificial Sequence
  source: /note="Description of Artificial Sequence: Synthetic oligonucleotide"
agcagtcatcagccattcct

SEQ ID NO: 1254 - DNA, 20 bp, Artificial Sequence
  source: /note="Description of Artificial Sequence: Synthetic oligonucleotide"
aacccacacaggcccactgc

SEQ ID NO: 1255 - DNA, 20 bp, Artificial Sequence
  source: /note="Description of Artificial Sequence: Synthetic oligonucleotide"
ctcttttctgctgtggcctg

SEQ ID NO: 1256 - DNA, 20 bp, Artificial Sequence
  source: /note="Description of Artificial Sequence: Synthetic oligonucleotide"
gcagaacaccctggccctac

SEQ ID NO: 1257 - DNA, 20 bp, Artificial Sequence
  source: /note="Description of Artificial Sequence: Synthetic oligonucleotide"
aggagtcagttctccctttc

SEQ ID NO: 1258 - DNA, 20 bp, Artificial Sequence
  source: /note="Description of Artificial Sequence: Synthetic oligonucleotide"
tcacttctccagacaggcct

SEQ ID NO: 1259 - DNA, 20 bp, Artificial Sequence
  source: /note="Description of Artificial Sequence: Synthetic oligonucleotide"
cttcagggaccagaggcagc

SEQ ID NO: 1260 - DNA, 20 bp, Artificial Sequence
  source: /note="Description of Artificial Sequence: Synthetic oligonucleotide"
ttctggtgccttgggctttg

SEQ ID NO: 1261 - DNA, 20 bp, Artificial Sequence
  source: /note="Description of Artificial Sequence: Synthetic oligonucleotide"
ggttctggtgtccccagaat

SEQ ID NO: 1262 - DNA, 20 bp, Artificial Sequence
  source: /note="Description of Artificial Sequence: Synthetic oligonucleotide"
tgtggtacctggttagtgcc

SEQ ID NO: 1263 - DNA, 20 bp, Artificial Sequence
  source: /note="Description of Artificial Sequence: Synthetic oligonucleotide"
gaccaaggcaccaccccatc

SEQ ID NO: 1264 - DNA, 20 bp, Artificial Sequence
  source: /note="Description of Artificial Sequence: Synthetic oligonucleotide"
tggctgcctaatcctccagg

SEQ ID NO: 1265 - DNA, 20 bp, Artificial Sequence
  source: /note="Description of Artificial Sequence: Synthetic oligonucleotide"
tctggtgtccccagaatcca

SEQ ID NO: 1266 - DNA, 20 bp, Artificial Sequence
  source: /note="Description of Artificial Sequence: Synthetic oligonucleotide"
tgtcaacacctggcccttgc

SEQ ID NO: 1267 - DNA, 20 bp, Artificial Sequence
  source: /note="Description of Artificial Sequence: Synthetic oligonucleotide"
gctgcctggtggattggtac

SEQ ID NO: 1268 - DNA, 20 bp, Artificial Sequence
  source: /note="Description of Artificial Sequence: Synthetic oligonucleotide"
gagaccaaggcaccacccca

SEQ ID NO: 1269 - DNA, 20 bp, Artificial Sequence
  source: /note="Description of Artificial Sequence: Synthetic oligonucleotide"
caggtgctctcttttctgct

SEQ ID NO: 1270 - DNA, 20 bp, Artificial Sequence
  source: /note="Description of Artificial Sequence: Synthetic oligonucleotide"
ctggctgactcagccccaac

SEQ ID NO: 1271 - DNA, 20 bp, Artificial Sequence
  source: /note="Description of Artificial Sequence: Synthetic oligonucleotide"
gcaaggctgtgttctctctc

SEQ ID NO: 1272 - DNA, 20 bp, Artificial Sequence
  source: /note="Description of Artificial Sequence: Synthetic oligonucleotide"
aagccaggcctaggtgcttg

SEQ ID NO: 1273 - DNA, 20 bp, Artificial Sequence
  source: /note="Description of Artificial Sequence: Synthetic oligonucleotide"
actgcacagccccaaccagg

SEQ ID NO: 1274 - DNA, 20 bp, Artificial Sequence
  source: /note="Description of Artificial Sequence: Synthetic oligonucleotide"
ccagacaggccttgagggtt

SEQ ID NO: 1275 - DNA, 20 bp, Artificial Sequence
  source: /note="Description of Artificial Sequence: Synthetic oligonucleotide"
agcagaacaccctggcccta

SEQ ID NO: 1276 - DNA, 20 bp, Artificial Sequence
  source: /note="Description of Artificial Sequence: Synthetic oligonucleotide"
ttggctatggcctacccact

SEQ ID NO: 1277 - DNA, 20 bp, Artificial Sequence
  source: /note="Description of Artificial Sequence: Synthetic oligonucleotide"
cttggctatggcctacccac

SEQ ID NO: 1278 - DNA, 20 bp, Artificial Sequence
  source: /note="Description of Artificial Sequence: Synthetic oligonucleotide"
ggcagaggatcatgccacct

SEQ ID NO: 1279 - DNA, 20 bp, Artificial Sequence
  source: /note="Description of Artificial Sequence: Synthetic oligonucleotide"
atccttggctatggcctacc

SEQ ID NO: 1280 - DNA, 20 bp, Artificial Sequence
  source: /note="Description of Artificial Sequence: Synthetic oligonucleotide"
gccagaggagaggtcctgag

SEQ ID NO: 1281 - DNA, 20 bp, Artificial Sequence
  source: /note="Description of Artificial Sequence: Synthetic oligonucleotide"
tgtccctgagcagttcttgg

SEQ ID NO: 1282 - DNA, 20 bp, Artificial Sequence
  source: /note="Description of Artificial Sequence: Synthetic oligonucleotide"
tagttgtggctgggccacag

SEQ ID NO: 1283 - DNA, 20 bp, Artificial Sequence
  source: /note="Description of Artificial Sequence: Synthetic oligonucleotide"
tcctagtatgggtggcagtc

SEQ ID NO: 1284 - DNA, 20 bp, Artificial Sequence
  source: /note="Description of Artificial Sequence: Synthetic oligonucleotide"
acacaggcccactgcaggac

SEQ ID NO: 1285 - DNA, 20 bp, Artificial Sequence
  source: /note="Description of Artificial Sequence: Synthetic oligonucleotide"
agctgcctggtggattggta

SEQ ID NO: 1286 - DNA, 20 bp, Artificial Sequence
  source: /note="Description of Artificial Sequence: Synthetic oligonucleotide"
ctccagacaggccttgaggg

SEQ ID NO: 1287 - DNA, 20 bp, Artificial Sequence
  source: /note="Description of Artificial Sequence: Synthetic oligonucleotide"
cttttctgctgtggcctgtg

SEQ ID NO: 1288 - DNA, 20 bp, Artificial Sequence
  source: /note="Description of Artificial Sequence: Synthetic oligonucleotide"
gggtggcagtcacctctgaa

SEQ ID NO: 1289 - DNA, 20 bp, Artificial Sequence
  source: /note="Description of Artificial Sequence: Synthetic oligonucleotide"
ttgcctttgctgtggttggg

SEQ ID NO: 1290 - DNA, 20 bp, Artificial Sequence
  source: /note="Description of Artificial Sequence: Synthetic oligonucleotide"
acaggagtcagttctccctt

SEQ ID NO: 1291 - DNA, 20 bp, Artificial Sequence
  source: /note="Description of Artificial Sequence: Synthetic oligonucleotide"
gacctcaggagggagtggga

SEQ ID NO: 1292 - DNA, 20 bp, Artificial Sequence
  source: /note="Description of Artificial Sequence: Synthetic oligonucleotide"
ccttgagggttccccacatg

SEQ ID NO: 1293 - DNA, 20 bp, Artificial Sequence
  source: /note="Description of Artificial Sequence: Synthetic oligonucleotide"
ggccaggaagctttgtcagc

SEQ ID NO: 1294 - DNA, 20 bp, Artificial Sequence
  source: /note="Description of Artificial Sequence: Synthetic oligonucleotide"
gcctgtgtgaatagcctggc

SEQ ID NO: 1295 - DNA, 20 bp, Artificial Sequence
  source: /note="Description of Artificial Sequence: Synthetic oligonucleotide"
gctggactctgattccctca

SEQ ID NO: 1296 - DNA, 20 bp, Artificial Sequence
  source: /note="Description of Artificial Sequence: Synthetic oligonucleotide"
gtgctgggttctgtcagatc

SEQ ID NO: 1297 - DNA, 20 bp, Artificial Sequence
  source: /note="Description of Artificial Sequence: Synthetic oligonucleotide"
tcagttctccctttctgcta

SEQ ID NO: 1298 - DNA, 20 bp, Artificial Sequence
  source: /note="Description of Artificial Sequence: Synthetic oligonucleotide"
cagcctctgggtctttatgc

SEQ ID NO: 1299 - DNA, 20 bp, Artificial Sequence
  source: /note="Description of Artificial Sequence: Synthetic oligonucleotide"
ctcttctcctcccaaccaga

SEQ ID NO: 1300 - DNA, 20 bp, Artificial Sequence
  source: /note="Description of Artificial Sequence: Synthetic oligonucleotide"
aggatctggctgactcagcc

SEQ ID NO: 1301 - DNA, 20 bp, Artificial Sequence
  source: /note="Description of Artificial Sequence: Synthetic oligonucleotide"
aggagaagccaggcctaggt

SEQ ID NO: 1302 - DNA, 20 bp, Artificial Sequence
  source: /note="Description of Artificial Sequence: Synthetic oligonucleotide"
gtgccagccttgggaaggag

SEQ ID NO: 1303 - DNA, 20 bp, Artificial Sequence
  source: /note="Description of Artificial Sequence: Synthetic oligonucleotide"
agtgccagccttgggaagga

SEQ ID NO: 1304 - DNA, 20 bp, Artificial Sequence
  source: /note="Description of Artificial Sequence: Synthetic oligonucleotide"
acaggcccactgcaggacag

SEQ ID NO: 1305 - DNA, 20 bp, Artificial Sequence
  source: /note="Description of Artificial Sequence: Synthetic oligonucleotide"
ctctggtgccatacagagcc

SEQ ID NO: 1306 - DNA, 20 bp, Artificial Sequence
  source: /note="Description of Artificial Sequence: Synthetic oligonucleotide"
tcagggaccagaggcagcac

SEQ ID NO: 1307 - DNA, 20 bp, Artificial Sequence
  source: /note="Description of Artificial Sequence: Synthetic oligonucleotide"
caggagtcagttctcccttt

SEQ ID NO: 1308 - DNA, 20 bp, Artificial Sequence
  source: /note="Description of Artificial Sequence: Synthetic oligonucleotide"
tccctggatattgtcctcca

SEQ ID NO: 1309 - DNA, 20 bp, Artificial Sequence
  source: /note="Description of Artificial Sequence: Synthetic oligonucleotide"
actctacccagccactctga

SEQ ID NO: 1310 - DNA, 20 bp, Artificial Sequence
  source: /note="Description of Artificial Sequence: Synthetic oligonucleotide"
tgagcagttcttggcccttg

SEQ ID NO: 1311 - DNA, 20 bp, Artificial Sequence
  source: /note="Description of Artificial Sequence: Synthetic oligonucleotide"
ttctggtgtccccagaatcc

SEQ ID NO: 1312 - DNA, 20 bp, Artificial Sequence
  source: /note="Description of Artificial Sequence: Synthetic oligonucleotide"
gggctggatgctggactctg

SEQ ID NO: 1313 - DNA, 20 bp, Artificial Sequence
  source: /note="Description of Artificial Sequence: Synthetic oligonucleotide"
gcaactggaggtctgcagct

SEQ ID NO: 1314 - DNA, 20 bp, Artificial Sequence
  source: /note="Description of Artificial Sequence: Synthetic oligonucleotide"
ctgcctaatcctccaggagc

SEQ ID NO: 1315 - DNA, 20 bp, Artificial Sequence
  source: /note="Description of Artificial Sequence: Synthetic oligonucleotide"
gctgcctaatcctccaggag

SEQ ID NO: 1316 - DNA, 20 bp, Artificial Sequence
  source: /note="Description of Artificial Sequence: Synthetic oligonucleotide"
ctgcctggtggattggtacc

SEQ ID NO: 1317 - DNA, 20 bp, Artificial Sequence
  source: /note="Description of Artificial Sequence: Synthetic oligonucleotide"
tttcctcttctcctcccaac

SEQ ID NO: 1318 - DNA, 20 bp, Artificial Sequence
  source: /note="Description of Artificial Sequence: Synthetic oligonucleotide"
ttcagggaccagaggcagca

SEQ ID NO: 1319 - DNA, 20 bp, Artificial Sequence
  source: /note="Description of Artificial Sequence: Synthetic oligonucleotide"
tctttatgccccagtctgga

SEQ ID NO: 1320 - DNA, 20 bp, Artificial Sequence
  source: /note="Description of Artificial Sequence: Synthetic oligonucleotide"
cactctacccagccactctg

SEQ ID NO: 1321 - DNA, 20 bp, Artificial Sequence
  source: /note="Description of Artificial Sequence: Synthetic oligonucleotide"
gttctggtgtccccagaatc

SEQ ID NO: 1322 - DNA, 20 bp, Artificial Sequence
  source: /note="Description of Artificial Sequence: Synthetic oligonucleotide"
gtgtcaacacctggcccttg

SEQ ID NO: 1323 - DNA, 20 bp, Artificial Sequence
  source: /note="Description of Artificial Sequence: Synthetic oligonucleotide"
tggtgccatacagagcccac

SEQ ID NO: 1324 - DNA, 20 bp, Artificial Sequence
  source: /note="Description of Artificial Sequence: Synthetic oligonucleotide"
caaggctgtgttctctctcc

SEQ ID NO: 1325 - DNA, 20 bp, Artificial Sequence
  source: /note="Description of Artificial Sequence: Synthetic oligonucleotide"
gtgtctgagcaggctttgga

SEQ ID NO: 1326 - DNA, 20 bp, Artificial Sequence
  source: /note="Description of Artificial Sequence: Synthetic oligonucleotide"
cctagtatgggtggcagtca

SEQ ID NO: 1327 - DNA, 20 bp, Artificial Sequence
  source: /note="Description of Artificial Sequence: Synthetic oligonucleotide"
ggctagatcagcaatgcccc

SEQ ID NO: 1328 - DNA, 20 bp, Artificial Sequence
  source: /note="Description of Artificial Sequence: Synthetic oligonucleotide"
cactcccctggctgaagagt

SEQ ID NO: 1329 - DNA, 20 bp, Artificial Sequence
  source: /note="Description of Artificial Sequence: Synthetic oligonucleotide"
ggagaagccaggcctaggtg

SEQ ID NO: 1330 - DNA, 20 bp, Artificial Sequence
  source: /note="Description of Artificial Sequence: Synthetic oligonucleotide"
cctaggtgcttgacctggtg

SEQ ID NO: 1331 - DNA, 20 bp, Artificial Sequence
  source: /note="Description of Artificial Sequence: Synthetic oligonucleotide"
gccaggaagctttgtcagct

SEQ ID NO: 1332 - DNA, 20 bp, Artificial Sequence
  source: /note="Description of Artificial Sequence: Synthetic oligonucleotide"
gtgctctcttttctgctgtg

SEQ ID NO: 1333 - DNA, 20 bp, Artificial Sequence
  source: /note="Description of Artificial Sequence: Synthetic oligonucleotide"
cctgatctgcctggaccaga

SEQ ID NO: 1334 - DNA, 20 bp, Artificial Sequence
  source: /note="Description of Artificial Sequence: Synthetic oligonucleotide"
actgtgggttctcctggtat

SEQ ID NO: 1335 - DNA, 20 bp, Artificial Sequence
  source: /note="Description of Artificial Sequence: Synthetic oligonucleotide"
ctccttccagcccaaactgc

SEQ ID NO: 1336 - DNA, 20 bp, Artificial Sequence
  source: /note="Description of Artificial Sequence: Synthetic oligonucleotide"
ccccaaccaggttcccaaca

SEQ ID NO: 1337 - DNA, 20 bp, Artificial Sequence
  source: /note="Description of Artificial Sequence: Synthetic oligonucleotide"
cctgtgtgaatagcctggcc

SEQ ID NO: 1338 - DNA, 20 bp, Artificial Sequence
  source: /note="Description of Artificial Sequence: Synthetic oligonucleotide"
acctcaggagggagtgggac

SEQ ID NO: 1339 - DNA, 20 bp, Artificial Sequence
  source: /note="Description of Artificial Sequence: Synthetic oligonucleotide"
gagtcagttctccctttctg

SEQ ID NO: 1340 - DNA, 20 bp, Artificial Sequence
  source: /note="Description of Artificial Sequence: Synthetic oligonucleotide"
agaccaaggcaccaccccat

SEQ ID NO: 1341 - DNA, 20 bp, Artificial Sequence
  source: /note="Description of Artificial Sequence: Synthetic oligonucleotide"
tctccagacaggccttgagg

SEQ ID NO: 1342 - DNA, 20 bp, Artificial Sequence
  source: /note="Description of Artificial Sequence: Synthetic oligonucleotide"
attttccagagccatgtccc

SEQ ID NO: 1343 - DNA, 20 bp, Artificial Sequence
  source: /note="Description of Artificial Sequence: Synthetic oligonucleotide"
ccagcctctgggtctttatg

SEQ ID NO: 1344 - DNA, 20 bp, Artificial Sequence
  source: /note="Description of Artificial Sequence: Synthetic oligonucleotide"
cacttctccagacaggcctt

SEQ ID NO: 1345 - DNA, 20 bp, Artificial Sequence
  source: /note="Description of Artificial Sequence: Synthetic oligonucleotide"
gtctgagcaggctttggagg

SEQ ID NO: 1346 - DNA, 20 bp, Artificial Sequence
  source: /note="Description of Artificial Sequence: Synthetic oligonucleotide"
ccagcccaaactgcacagcc

SEQ ID NO: 1347 - DNA, 20 bp, Artificial Sequence
  source: /note="Description of Artificial Sequence: Synthetic oligonucleotide"
gtggcctgtgtgaatagcct

SEQ ID NO: 1348 - DNA, 20 bp, Artificial Sequence
  source: /note="Description of Artificial Sequence: Synthetic oligonucleotide"
ggtctctcacaggatgctgg

SEQ ID NO: 1349 - DNA, 20 bp, Artificial Sequence
  source: /note="Description of Artificial Sequence: Synthetic oligonucleotide"
tgtcagctagttgtggctgg

SEQ ID NO: 1350 - DNA, 20 bp, Artificial Sequence
  source: /note="Description of Artificial Sequence: Synthetic oligonucleotide"
tgccagccttgggaaggagg

SEQ ID NO: 1351 - DNA, 20 bp, Artificial Sequence
  source: /note="Description of Artificial Sequence: Synthetic oligonucleotide"
ggtgcttgacctggtgatct

SEQ ID NO: 1352 - DNA, 20 bp, Artificial Sequence
  source: /note="Description of Artificial Sequence: Synthetic oligonucleotide"
cctggtgatctgagctgtgt

SEQ ID NO: 1353 - DNA, 20 bp, Artificial Sequence
  source: /note="Description of Artificial Sequence: Synthetic oligonucleotide"
tggcaaggctgtgttctctc

SEQ ID NO: 1354 - DNA, 20 bp, Artificial Sequence
  source: /note="Description of Artificial Sequence: Synthetic oligonucleotide"
aggtgctctcttttctgctg

SEQ ID NO: 1355 - DNA, 20 bp, Artificial Sequence
  source: /note="Description of Artificial Sequence: Synthetic oligonucleotide"
gaccagcccaccccagtaaa

SEQ ID NO: 1356 - DNA, 20 bp, Artificial Sequence
  source: /note="Description of Artificial Sequence: Synthetic oligonucleotide"
gagggctggtttgcctcaac

SEQ ID NO: 1357 - DNA, 20 bp, Artificial Sequence
  source: /note="Description of Artificial Sequence: Synthetic oligonucleotide"
gtgtagcagtcatcagccat

SEQ ID NO: 1358 - DNA, 20 bp, Artificial Sequence
  source: /note="Description of Artificial Sequence: Synthetic oligonucleotide"
gccatacagagcccactgtg

SEQ ID NO: 1359 - DNA, 20 bp, Artificial Sequence
  source: /note="Description of Artificial Sequence: Synthetic oligonucleotide"
tgccatacagagcccactgt

SEQ ID NO: 1360 - DNA, 20 bp, Artificial Sequence
  source: /note="Description of Artificial Sequence: Synthetic oligonucleotide"
gtgccatacagagcccactg

SEQ ID NO: 1361 - DNA, 20 bp, Artificial Sequence
  source: /note="Description of Artificial Sequence: Synthetic oligonucleotide"
ggaatccttaccctctgggt

SEQ ID NO: 1362 - DNA, 20 bp, Artificial Sequence
  source: /note="Description of Artificial Sequence: Synthetic oligonucleotide"
gatggctgcctaatcctcca

SEQ ID NO: 1363 - DNA, 20 bp, Artificial Sequence
  source: /note="Description of Artificial Sequence: Synthetic oligonucleotide"
tacagagcccactgtgggtt

SEQ ID NO: 1364 - DNA, 20 bp, Artificial Sequence
  source: /note="Description of Artificial Sequence: Synthetic oligonucleotide"
acaggtgctctcttttctgc

SEQ ID NO: 1365 - DNA, 20 bp, Artificial Sequence
  source: /note="Description of Artificial Sequence: Synthetic oligonucleotide"
tttcccagcactttctctgt

SEQ ID NO: 1366 - DNA, 20 bp, Artificial Sequence
  source: /note="Description of Artificial Sequence: Synthetic oligonucleotide"
ccagccttgggaaggaggga

SEQ ID NO: 1367 - DNA, 20 bp, Artificial Sequence
  source: /note="Description of Artificial Sequence: Synthetic oligonucleotide"
gttagtgccagccttgggaa

SEQ ID NO: 1368 - DNA, 20 bp, Artificial Sequence
  source: /note="Description of Artificial Sequence: Synthetic oligonucleotide"
cacaggccagaggagaggtc

SEQ ID NO: 1369 - DNA, 20 bp, Artificial Sequence
  source: /note="Description of Artificial Sequence: Synthetic oligonucleotide"
ctggtgtccccagaatccat

SEQ ID NO: 1370 - DNA, 20 bp, Artificial Sequence
  source: /note="Description of Artificial Sequence: Synthetic oligonucleotide"
ggaggcttgtgacttcagct

SEQ ID NO: 1371 - DNA, 20 bp, Artificial Sequence
  source: /note="Description of Artificial Sequence: Synthetic oligonucleotide"
ggcttggtgatctctggagg

SEQ ID NO: 1372 - DNA, 20 bp, Artificial Sequence
  source: /note="Description of Artificial Sequence: Synthetic oligonucleotide"
gggcttggtgatctctggag

SEQ ID NO: 1373 - DNA, 20 bp, Artificial Sequence
  source: /note="Description of Artificial Sequence: Synthetic oligonucleotide"
cagcccaccccagtaaatcc

SEQ ID NO: 1374 - DNA, 20 bp, Artificial Sequence
  source: /note="Description of Artificial Sequence: Synthetic oligonucleotide"
ccagcccaccccagtaaatc

SEQ ID NO: 1375 - DNA, 20 bp, Artificial Sequence
  source: /note="Description of Artificial Sequence: Synthetic oligonucleotide"
tgctggactctgattccctc

SEQ ID NO: 1376 - DNA, 20 bp, Artificial Sequence
  source: /note="Description of Artificial Sequence: Synthetic oligonucleotide"
cctgtgtcacttctccagac

SEQ ID NO: 1377 - DNA, 20 bp, Artificial Sequence
  source: /note="Description of Artificial Sequence: Synthetic oligonucleotide"
atcctccaggagccattttc

SEQ ID NO: 1378 - DNA, 20 bp, Artificial Sequence
  source: /note="Description of Artificial Sequence: Synthetic oligonucleotide"
aagcagaacaccctggccct

SEQ ID NO: 1379 - DNA, 20 bp, Artificial Sequence
  source: /note="Description of Artificial Sequence: Synthetic oligonucleotide"
aaccccacaggccagaggag

SEQ ID NO: 1380 - DNA, 20 bp, Artificial Sequence
  source: /note="Description of Artificial Sequence: Synthetic oligonucleotide"
tggtacctggttagtgccag

SEQ ID NO: 1381 - DNA, 20 bp, Artificial Sequence
  source: /note="Description of Artificial Sequence: Synthetic oligonucleotide"
tattgtcctccagctctcag

SEQ ID NO: 1382 - DNA, 20 bp, Artificial Sequence
  source: /note="Description of Artificial Sequence: Synthetic oligonucleotide"
atacagagcccactgtgggt

SEQ ID NO: 1383 - DNA, 20 bp, Artificial Sequence
  source: /note="Description of Artificial Sequence: Synthetic oligonucleotide"
aacagcttctccagcctctg

SEQ ID NO: 1384 - DNA, 20 bp, Artificial Sequence
  source: /note="Description of Artificial Sequence: Synthetic oligonucleotide"
tgcaggacaggtggcagagg

SEQ ID NO: 1385 - DNA, 20 bp, Artificial Sequence
  source: /note="Description of Artificial Sequence: Synthetic oligonucleotide"
tgctctcttttctgctgtgg

SEQ ID NO: 1386 - DNA, 20 bp, Artificial Sequence
  source: /note="Description of Artificial Sequence: Synthetic oligonucleotide"
tgtctaagggcagtgctctc

SEQ ID NO: 1387 - DNA, 20 bp, Artificial Sequence
  source: /note="Description of Artificial Sequence: Synthetic oligonucleotide"
aaggccacttctgagtcctc

SEQ ID NO: 1388 - DNA, 20 bp, Artificial Sequence
  source: /note="Description of Artificial Sequence: Synthetic oligonucleotide"
tgagctgcctggtggattgg

SEQ ID NO: 1389 - DNA, 20 bp, Artificial Sequence
  source: /note="Description of Artificial Sequence: Synthetic oligonucleotide"
ggctggatgctggactctga

SEQ ID NO: 1390 - DNA, 20 bp, Artificial Sequence
  source: /note="Description of Artificial Sequence: Synthetic oligonucleotide"
ggagaggtcctgagagaggt

SEQ ID NO: 1391 - DNA, 20 bp, Artificial Sequence
  source: /note="Description of Artificial Sequence: Synthetic oligonucleotide"
ctggtctctcacaggatgct

SEQ ID NO: 1392 - DNA, 20 bp, Artificial Sequence
  source: /note="Description of Artificial Sequence: Synthetic oligonucleotide"
gccaagcagaacaccctggc

SEQ ID NO: 1393 - DNA, 20 bp, Artificial Sequence
  source: /note="Description of Artificial Sequence: Synthetic oligonucleotide"
gatattgtcctccagctctc

SEQ ID NO: 1394 - DNA, 20 bp, Artificial Sequence
  source: /note="Description of Artificial Sequence: Synthetic oligonucleotide"
tattcctgctctgtatggcc

SEQ ID NO: 1395 - DNA, 20 bp, Artificial Sequence
  source: /note="Description of Artificial Sequence: Synthetic oligonucleotide"
tgtccctggatattgtcctc

SEQ ID NO: 1396 - DNA, 20 bp, Artificial Sequence
  source: /note="Description of Artificial Sequence: Synthetic oligonucleotide"
ctcaggagaagccaggccta

SEQ ID NO: 1397 - DNA, 20 bp, Artificial Sequence
  source: /note="Description of Artificial Sequence: Synthetic oligonucleotide"
cctaatcctccaggagccat

SEQ ID NO: 1398 - DNA, 20 bp, Artificial Sequence
  source: /note="Description of Artificial Sequence: Synthetic oligonucleotide"
accagaaggccacacagggc

SEQ ID NO: 1399 - DNA, 20 bp, Artificial Sequence
  source: /note="Description of Artificial Sequence: Synthetic oligonucleotide"
cagacaggccttgagggttc

SEQ ID NO: 1400 - DNA, 20 bp, Artificial Sequence
  source: /note="Description of Artificial Sequence: Synthetic oligonucleotide"
ggcctgtgtgaatagcctgg

SEQ ID NO: 1401 - DNA, 20 bp, Artificial Sequence
  source: /note="Description of Artificial Sequence: Synthetic oligonucleotide"
gcagatggctgcctaatcct

SEQ ID NO: 1402 - DNA, 20 bp, Artificial Sequence
  source: /note="Description of Artificial Sequence: Synthetic oligonucleotide"
aatccttaccctctgggtgt

SEQ ID NO: 1403 - DNA, 20 bp, Artificial Sequence
  source: /note="Description of Artificial Sequence: Synthetic oligonucleotide"
actcccctggctgaagagtg

SEQ ID NO: 1404 - DNA, 20 bp, Artificial Sequence
  source: /note="Description of Artificial Sequence: Synthetic oligonucleotide"
ttgtcctagtatgggtggca

SEQ ID NO: 1405 - DNA, 20 bp, Artificial Sequence
  source: /note="Description of Artificial Sequence: Synthetic oligonucleotide"
actggccttggcttagagga

SEQ ID NO: 1406 - DNA, 20 bp, Artificial Sequence
  source: /note="Description of Artificial Sequence: Synthetic oligonucleotide"
tgtctcaggagaagccaggc

SEQ ID NO: 1407 - DNA, 20 bp, Artificial Sequence
  source: /note="Description of Artificial Sequence: Synthetic oligonucleotide"
ggttcaggagagctacctgg

SEQ ID NO: 1408 - DNA, 20 bp, Artificial Sequence
  source: /note="Description of Artificial Sequence: Synthetic oligonucleotide"
tgcttggcaaggctgtgttc

SEQ ID NO: 1409 - DNA, 20 bp, Artificial Sequence
  source: /note="Description of Artificial Sequence: Synthetic oligonucleotide"
atattgtcctccagctctca

SEQ ID NO: 1410 - DNA, 20 bp, Artificial Sequence
  source: /note="Description of Artificial Sequence: Synthetic oligonucleotide"
tgtcctagtatgggtggcag

SEQ ID NO: 1411 - DNA, 20 bp, Artificial Sequence
  source: /note="Description of Artificial Sequence: Synthetic oligonucleotide"
gggaggatctggctgactca

SEQ ID NO: 1412 - DNA, 20 bp, Artificial Sequence
  source: /note="Description of Artificial Sequence: Synthetic oligonucleotide"
agatggctgcctaatcctcc

SEQ ID NO: 1413 - DNA, 20 bp, Artificial Sequence
  source: /note="Description of Artificial Sequence: Synthetic oligonucleotide"
cagttctccctttctgctat

SEQ ID NO: 1414 - DNA, 20 bp, Artificial Sequence
  source: /note="Description of Artificial Sequence: Synthetic oligonucleotide"
ggcttgtgacttcagctgtt

SEQ ID NO: 1415 - DNA, 20 bp, Artificial Sequence
  source: /note="Description of Artificial Sequence: Synthetic oligonucleotide"
tctggtctctcacaggatgc

SEQ ID NO: 1416 - DNA, 20 bp, Artificial Sequence
  source: /note="Description of Artificial Sequence: Synthetic oligonucleotide"
tgtcacttctccagacaggc

SEQ ID NO: 1417 - DNA, 20 bp, Artificial Sequence
  source: /note="Description of Artificial Sequence: Synthetic oligonucleotide"
gctagatcagcaatgcccca

SEQ ID NO: 1418 - DNA, 20 bp, Artificial Sequence
  source: /note="Description of Artificial Sequence: Synthetic oligonucleotide"
ctgtgggttctcctggtata

SEQ ID NO: 1419 - DNA, 20 bp, Artificial Sequence
  source: /note="Description of Artificial Sequence: Synthetic oligonucleotide"
tagtatgggtggcagtcacc

SEQ ID NO: 1420 - DNA, 20 bp, Artificial Sequence
  source: /note="Description of Artificial Sequence: Synthetic oligonucleotide"
ggtggcagtcacctctgaac

SEQ ID NO: 1421 - DNA, 20 bp, Artificial Sequence
  source: /note="Description of Artificial Sequence: Synthetic oligonucleotide"
tgttgcctttgctgtggttg

SEQ ID NO: 1422 - DNA, 20 bp, Artificial Sequence
  source: /note="Description of Artificial Sequence: Synthetic oligonucleotide"
gcagaggatcatgccacctt

SEQ ID NO: 1423 - DNA, 20 bp, Artificial Sequence
  source: /note="Description of Artificial Sequence: Synthetic oligonucleotide"
ggaggttcaggagagctacc

SEQ ID NO: 1424 - DNA, 20 bp, Artificial Sequence
  source: /note="Description of Artificial Sequence: Synthetic oligonucleotide"
aggcttgtgacttcagctgt

SEQ ID NO: 1425 - DNA, 20 bp, Artificial Sequence
  source: /note="Description of Artificial Sequence: Synthetic oligonucleotide"
tagtgccagccttgggaagg

SEQ ID NO: 1426 - DNA, 20 bp, Artificial Sequence
  source: /note="Description of Artificial Sequence: Synthetic oligonucleotide"
gattgggtaatgcagggccc

SEQ ID NO: 1427 - DNA, 20 bp, Artificial Sequence
  source: /note="Description of Artificial Sequence: Synthetic oligonucleotide"
cactggccttggcttagagg

SEQ ID NO: 1428 - DNA, 20 bp, Artificial Sequence
  source: /note="Description of Artificial Sequence: Synthetic oligonucleotide"
ccctacagacctgtgtctga

SEQ ID NO: 1429 - DNA, 20 bp, Artificial Sequence
  source: /note="Description of Artificial Sequence: Synthetic oligonucleotide"
agcaactggaggtctgcagc

SEQ ID NO: 1430 - DNA, 20 bp, Artificial Sequence
  source: /note="Description of Artificial Sequence: Synthetic oligonucleotide"
gatccttggctatggcctac

SEQ ID NO: 1431 - DNA, 20 bp, Artificial Sequence
  source: /note="Description of Artificial Sequence: Synthetic oligonucleotide"
tagcagtcatcagccattcc

SEQ ID NO: 1432 - DNA, 20 bp, Artificial Sequence
  source: /note="Description of Artificial Sequence: Synthetic oligonucleotide"
cagagccatgtccctggata

SEQ ID NO: 1433 - DNA, 20 bp, Artificial Sequence
  source: /note="Description of Artificial Sequence: Synthetic oligonucleotide"
atggctgcctaatcctccag

SEQ ID NO: 1434 - DNA, 20 bp, Artificial Sequence
  source: /note="Description of Artificial Sequence: Synthetic oligonucleotide"
tgtgctgggttctgtcagat

SEQ ID NO: 1435 - DNA, 20 bp, Artificial Sequence
  source: /note="Description of Artificial Sequence: Synthetic oligonucleotide"
atgtgctgggttctgtcaga

SEQ ID NO: 1436 - DNA, 20 bp, Artificial Sequence
  source: /note="Description of Artificial Sequence: Synthetic oligonucleotide"
ctggccttggcttagaggag

SEQ ID NO: 1437 - DNA, 20 bp, Artificial Sequence
  source: /note="Description of Artificial Sequence: Synthetic oligonucleotide"
tgtgtctgagcaggctttgg

SEQ ID NO: 1438 - DNA, 20 bp, Artificial Sequence
  source: /note="Description of Artificial Sequence: Synthetic oligonucleotide"
gtgaatagcctggccatgct

SEQ ID NO: 1439 - DNA, 20 bp, Artificial Sequence
  source: /note="Description of Artificial Sequence: Synthetic oligonucleotide"
acttctccagacaggccttg

SEQ ID NO: 1440 - DNA, 20 bp, Artificial Sequence
  source: /note="Description of Artificial Sequence: Synthetic oligonucleotide"
cttgagggttccccacatga

SEQ ID NO: 1441 - DNA, 20 bp, Artificial Sequence
  source: /note="Description of Artificial Sequence: Synthetic oligonucleotide"
atcctcctcaagctgactgc

SEQ ID NO: 1442 - DNA, 20 bp, Artificial Sequence
  source: /note="Description of Artificial Sequence: Synthetic oligonucleotide"
caagcagaacaccctggccc

SEQ ID NO: 1443 - DNA, 20 bp, Artificial Sequence
  source: /note="Description of Artificial Sequence: Synthetic oligonucleotide"
ccaagcagaacaccctggcc

SEQ ID NO: 1444 - DNA, 20 bp, Artificial Sequence
  source: /note="Description of Artificial Sequence: Synthetic oligonucleotide"
accagcccaccccagtaaat

SEQ ID NO: 1445 - DNA, 20 bp, Artificial Sequence
  source: /note="Description of Artificial Sequence: Synthetic oligonucleotide"
agaaggccacacagggcagt

SEQ ID NO: 1446 - DNA, 20 bp, Artificial Sequence
  source: /note="Description of Artificial Sequence: Synthetic oligonucleotide"
gtctctcacaggatgctgga

SEQ ID NO: 1447 - DNA, 20 bp, Artificial Sequence
  source: /note="Description of Artificial Sequence: Synthetic oligonucleotide"
taaccccacaggccagagga

SEQ ID NO: 1448 - DNA, 20 bp, Artificial Sequence
  source: /note="Description of Artificial Sequence: Synthetic oligonucleotide"
gtagcagtcatcagccattc

SEQ ID NO: 1449 - DNA, 20 bp, Artificial Sequence
  source: /note="Description of Artificial Sequence: Synthetic oligonucleotide"
gagagaccaaggcaccaccc

SEQ ID NO: 1450 - DNA, 20 bp, Artificial Sequence
  source: /note="Description of Artificial Sequence: Synthetic oligonucleotide"
gacctggtgatctgagctgt

SEQ ID NO: 1451 - DNA, 20 bp, Artificial Sequence
  source: /note="Description of Artificial Sequence: Synthetic oligonucleotide"
caggagaagccaggcctagg

SEQ ID NO: 1452 - DNA, 20 bp, Artificial Sequence
  source: /note="Description of Artificial Sequence: Synthetic oligonucleotide"
ttggcaaggctgtgttctct

SEQ ID NO: 1453 - DNA, 20 bp, Artificial Sequence
  source: /note="Description of Artificial Sequence: Synthetic oligonucleotide"
atctgagctgtgtttgtcct

SEQ ID NO: 1454 - DNA, 20 bp, Artificial Sequence
  source: /note="Description of Artificial Sequence: Synthetic oligonucleotide"
gaggatctggctgactcagc

SEQ ID NO: 1455 - DNA, 20 bp, Artificial Sequence
  source: /note="Description of Artificial Sequence: Synthetic oligonucleotide"
cacttcagggaccagaggca

SEQ ID NO: 1456 - DNA, 20 bp, Artificial Sequence
  source: /note="Description of Artificial Sequence: Synthetic oligonucleotide"
gtgtccccagaatccatgtg

SEQ ID NO: 1457 - DNA, 20 bp, Artificial Sequence
  source: /note="Description of Artificial Sequence: Synthetic oligonucleotide"
tctaagggcagtgctctctt

SEQ ID NO: 1458 - DNA, 20 bp, Artificial Sequence
  source: /note="Description of Artificial Sequence: Synthetic oligonucleotide"
atggcagcttcattcctgga

SEQ ID NO: 1459 - DNA, 20 bp, Artificial Sequence
  source: /note="Description of Artificial Sequence: Synthetic oligonucleotide"
ctttctctgtgcccagagat

SEQ ID NO: 1460 - DNA, 20 bp, Artificial Sequence
  source: /note="Description of Artificial Sequence: Synthetic oligonucleotide"
gggagactggtttcaggagc

SEQ ID NO: 1461 - DNA, 20 bp, Artificial Sequence
  source: /note="Description of Artificial Sequence: Synthetic oligonucleotide"
tttgtcctagtatgggtggc

SEQ ID NO: 1462 - DNA, 20 bp, Artificial Sequence
  source: /note="Description of Artificial Sequence: Synthetic oligonucleotide"
tgctgggttctgtcagatca

SEQ ID NO: 1463 - DNA, 20 bp, Artificial Sequence
  source: /note="Description of Artificial Sequence: Synthetic oligonucleotide"
ccctttctgctatccatcac

SEQ ID NO: 1464 - DNA, 20 bp, Artificial Sequence
  source: /note="Description of Artificial Sequence: Synthetic oligonucleotide"
gcttggtgatctctggagga

SEQ ID NO: 1465 - DNA, 20 bp, Artificial Sequence
  source: /note="Description of Artificial Sequence: Synthetic oligonucleotide"
tcaggagagctacctggacc

SEQ ID NO: 1466 - DNA, 20 bp, Artificial Sequence
  source: /note="Description of Artificial Sequence: Synthetic oligonucleotide"
ctgctgtggcctgtgtgaat

SEQ ID NO: 1467 - DNA, 20 bp, Artificial Sequence
  source: /note="Description of Artificial Sequence: Synthetic oligonucleotide"
tcacaggtgctctcttttct

SEQ ID NO: 1468 - DNA, 20 bp, Artificial Sequence
  source: /note="Description of Artificial Sequence: Synthetic oligonucleotide"
cagacctgtgtctgagcagg

SEQ ID NO: 1469 - DNA, 20 bp, Artificial Sequence
  source: /note="Description of Artificial Sequence: Synthetic oligonucleotide"
tccagcccaaactgcacagc

SEQ ID NO: 1470 - DNA, 20 bp, Artificial Sequence
  source: /note="Description of Artificial Sequence: Synthetic oligonucleotide"
gaggttcaggagagctacct

SEQ ID NO: 1471 - DNA, 20 bp, Artificial Sequence
  source: /note="Description of Artificial Sequence: Synthetic oligonucleotide"
aggtgcttgacctggtgatc

SEQ ID NO: 1472 - DNA, 20 bp, Artificial Sequence
  source: /note="Description of Artificial Sequence: Synthetic oligonucleotide"
ccatacagagcccactgtgg

SEQ ID NO: 1473 - DNA, 20 bp, Artificial Sequence
  source: /note="Description of Artificial Sequence: Synthetic oligonucleotide"
gtgtttgtcctagtatgggt

SEQ ID NO: 1474 - DNA, 20 bp, Artificial Sequence
  source: /note="Description of Artificial Sequence: Synthetic oligonucleotide"
aagggcagtgctctctttgg

SEQ ID NO: 1475 - DNA, 20 bp, Artificial Sequence
  source: /note="Description of Artificial Sequence: Synthetic oligonucleotide"
cattgctgcttggcaaggct

SEQ ID NO: 1476 - DNA, 20 bp, Artificial Sequence
  source: /note="Description of Artificial Sequence: Synthetic oligonucleotide"
tttgtcagctagttgtggct

SEQ ID NO: 1477 - DNA, 20 bp, Artificial Sequence
  source: /note="Description of Artificial Sequence: Synthetic oligonucleotide"
ctttgtcagctagttgtggc

SEQ ID NO: 1478 - DNA, 20 bp, Artificial Sequence
  source: /note="Description of Artificial Sequence: Synthetic oligonucleotide"
gctttgtcagctagttgtgg

SEQ ID NO: 1479 - DNA, 20 bp, Artificial Sequence
  source: /note="Description of Artificial Sequence: Synthetic oligonucleotide"
gcctctgtctaggatctaga

SEQ ID NO: 1480 - DNA, 20 bp, Artificial Sequence
  source: /note="Description of Artificial Sequence: Synthetic oligonucleotide"
tggatattgtcctccagctc

SEQ ID NO: 1481 - DNA, 20 bp, Artificial Sequence
  source: /note="Description of Artificial Sequence: Synthetic oligonucleotide"
ccctggctgaagagtgccaa

SEQ ID NO: 1482 - DNA, 20 bp, Artificial Sequence
  source: /note="Description of Artificial Sequence: Synthetic oligonucleotide"
tgggcagaggatcatgccac

SEQ ID NO: 1483 - DNA, 20 bp, Artificial Sequence
  source: /note="Description of Artificial Sequence: Synthetic oligonucleotide"
gtgtcacttctccagacagg

SEQ ID NO: 1484 - DNA, 20 bp, Artificial Sequence
  source: /note="Description of Artificial Sequence: Synthetic oligonucleotide"
tcaactcactctacccagcc

SEQ ID NO: 1485 - DNA, 20 bp, Artificial Sequence
  source: /note="Description of Artificial Sequence: Synthetic oligonucleotide"
aggagccattttccaagggc

SEQ ID NO: 1486 - DNA, 20 bp, Artificial Sequence
  source: /note="Description of Artificial Sequence: Synthetic oligonucleotide"
gcttgtgacttcagctgttc

SEQ ID NO: 1487 - DNA, 20 bp, Artificial Sequence
  source: /note="Description of Artificial Sequence: Synthetic oligonucleotide"
ttgtctaagggcagtgctct

SEQ ID NO: 1488 - DNA, 20 bp, Artificial Sequence
  source: /note="Description of Artificial Sequence: Synthetic oligonucleotide"
cttgtctaagggcagtgctc

SEQ ID NO: 1489 - DNA, 20 bp, Artificial Sequence
  source: /note="Description of Artificial Sequence: Synthetic oligonucleotide"
tcttgtctaagggcagtgct

SEQ ID NO: 1490 - DNA, 20 bp, Artificial Sequence
  source: /note="Description of Artificial Sequence: Synthetic oligonucleotide"
ctcttgtctaagggcagtgc

SEQ ID NO: 1491 - DNA, 20 bp, Artificial Sequence
  source: /note="Description of Artificial Sequence: Synthetic oligonucleotide"
ctaggtgcttgacctggtga

SEQ ID NO: 1492 - DNA, 20 bp, Artificial Sequence
  source: /note="Description of Artificial Sequence: Synthetic oligonucleotide"
tgagctgtgtttgtcctagt

SEQ ID NO: 1493 - DNA, 20 bp, Artificial Sequence
  source: /note="Description of Artificial Sequence: Synthetic oligonucleotide"
atgctggactctgattccct

SEQ ID NO: 1494 - DNA, 20 bp, Artificial Sequence
  source: /note="Description of Artificial Sequence: Synthetic oligonucleotide"
aggaggcttgtgacttcagc

SEQ ID NO: 1495 - DNA, 20 bp, Artificial Sequence
  source: /note="Description of Artificial Sequence: Synthetic oligonucleotide"
ggcttagaggaggcttgtga

SEQ ID NO: 1496 - DNA, 20 bp, Artificial Sequence
  source: /note="Description of Artificial Sequence: Synthetic oligonucleotide"
acacttcagggaccagaggc

SEQ ID NO: 1497 - DNA, 20 bp, Artificial Sequence
  source: /note="Description of Artificial Sequence: Synthetic oligonucleotide"
tgtggcctgtgtgaatagcc

SEQ ID NO: 1498 - DNA, 20 bp, Artificial Sequence
  source: /note="Description of Artificial Sequence: Synthetic oligonucleotide"
tctgagcaggctttggagga

SEQ ID NO: 1499 - DNA, 20 bp, Artificial Sequence
  source: /note="Description of Artificial Sequence: Synthetic oligonucleotide"
ttctccagacaggccttgag

SEQ ID NO: 1500 - DNA, 20 bp, Artificial Sequence
  source: /note="Description of Artificial Sequence: Synthetic oligonucleotide"
cagcctctgtctaggatcta

SEQ ID NO: 1501 - DNA, 20 bp, Artificial Sequence
  source: /note="Description of Artificial Sequence: Synthetic oligonucleotide"
gcccacaatgggcagaggat

SEQ ID NO: 1502 - DNA, 20 bp, Artificial Sequence
  source: /note="Description of Artificial Sequence: Synthetic oligonucleotide"
gttcaggagagctacctgga

SEQ ID NO: 1503 - DNA, 20 bp, Artificial Sequence
  source: /note="Description of Artificial Sequence: Synthetic oligonucleotide"
gagccatgtccctggatatt

SEQ ID NO: 1504 - DNA, 20 bp, Artificial Sequence
  source: /note="Description of Artificial Sequence: Synthetic oligonucleotide"
gatctgagctgtgtttgtcc

SEQ ID NO: 1505 - DNA, 20 bp, Artificial Sequence
  source: /note="Description of Artificial Sequence: Synthetic oligonucleotide"
ccagccaagcagaacaccct

SEQ ID NO: 1506 - DNA, 20 bp, Artificial Sequence
  source: /note="Description of Artificial Sequence: Synthetic oligonucleotide"
caggagagctacctggacca

SEQ ID NO: 1507 - DNA, 20 bp, Artificial Sequence
  source: /note="Description of Artificial Sequence: Synthetic oligonucleotide"
ctgtgtgaatagcctggcca

SEQ ID NO: 1508 - DNA, 20 bp, Artificial Sequence
  source: /note="Description of Artificial Sequence: Synthetic oligonucleotide"
ggatttgcagtcagcagagc

SEQ ID NO: 1509 - DNA, 20 bp, Artificial Sequence
  source: /note="Description of Artificial Sequence: Synthetic oligonucleotide"
cacactggccttggcttaga

SEQ ID NO: 1510 - DNA, 20 bp, Artificial Sequence
  source: /note="Description of Artificial Sequence: Synthetic oligonucleotide"
gttgggatttgcagtcagca

SEQ ID NO: 1511 - DNA, 20 bp, Artificial Sequence
  source: /note="Description of Artificial Sequence: Synthetic oligonucleotide"
agagccatgtccctggatat

SEQ ID NO: 1512 - DNA, 20 bp, Artificial Sequence
  source: /note="Description of Artificial Sequence: Synthetic oligonucleotide"
aactgtgggttctcctggta

SEQ ID NO: 1513 - DNA, 20 bp, Artificial Sequence
  source: /note="Description of Artificial Sequence: Synthetic oligonucleotide"
tgcccacaatgggcagagga

SEQ ID NO: 1514 - DNA, 20 bp, Artificial Sequence
  source: /note="Description of Artificial Sequence: Synthetic oligonucleotide"
actctggtgccatacagagc

SEQ ID NO: 1515 - DNA, 20 bp, Artificial Sequence
  source: /note="Description of Artificial Sequence: Synthetic oligonucleotide"
gctgactgctatcagcagga

SEQ ID NO: 1516 - DNA, 20 bp, Artificial Sequence
  source: /note="Description of Artificial Sequence: Synthetic oligonucleotide"
ctcaggagggagtgggactg

SEQ ID NO: 1517 - DNA, 20 bp, Artificial Sequence
  source: /note="Description of Artificial Sequence: Synthetic oligonucleotide"
gtgtggctggacttttgacc

SEQ ID NO: 1518 - DNA, 20 bp, Artificial Sequence
  source: /note="Description of Artificial Sequence: Synthetic oligonucleotide"
tcaggagaagccaggcctag

SEQ ID NO: 1519 - DNA, 20 bp, Artificial Sequence
  source: /note="Description of Artificial Sequence: Synthetic oligonucleotide"
acttcagggaccagaggcag

SEQ ID NO: 1520 - DNA, 20 bp, Artificial Sequence
  source: /note="Description of Artificial Sequence: Synthetic oligonucleotide"
ttgtcagctagttgtggctg

SEQ ID NO: 1521 - DNA, 20 bp, Artificial Sequence
  source: /note="Description of Artificial Sequence: Synthetic oligonucleotide"
ccccagaatccatgtgtctt

SEQ ID NO: 1522 - DNA, 20 bp, Artificial Sequence
  source: /note="Description of Artificial Sequence: Synthetic oligonucleotide"
cccaaccaggttcccaacac

SEQ ID NO: 1523 - DNA, 20 bp, Artificial Sequence
  source: /note="Description of Artificial Sequence: Synthetic oligonucleotide"
tgggtcagctttttgttgca

SEQ ID NO: 1524 - DNA, 20 bp, Artificial Sequence
  source: /note="Description of Artificial Sequence: Synthetic oligonucleotide"
atgtccctggatattgtcct

SEQ ID NO: 1525 - DNA, 20 bp, Artificial Sequence
  source: /note="Description of Artificial Sequence: Synthetic oligonucleotide"
atgtggtacctggttagtgc

SEQ ID NO: 1526 - DNA, 20 bp, Artificial Sequence
  source: /note="Description of Artificial Sequence: Synthetic oligonucleotide"
gtggcagtcacctctgaaca

SEQ ID NO: 1527 - DNA, 20 bp, Artificial Sequence
  source: /note="Description of Artificial Sequence: Synthetic oligonucleotide"
gagctgtgtttgtcctagta

SEQ ID NO: 1528 - DNA, 20 bp, Artificial Sequence
  source: /note="Description of Artificial Sequence: Synthetic oligonucleotide"
tctttttccatctgtcctgg

SEQ ID NO: 1529 - DNA, 20 bp, Artificial Sequence
  source: /note="Description of Artificial Sequence: Synthetic oligonucleotide"
tcatcctcctcaagctgact

SEQ ID NO: 1530 - DNA, 20 bp, Artificial Sequence
  source: /note="Description of Artificial Sequence: Synthetic oligonucleotide"
gtttgtcctagtatgggtgg

SEQ ID NO: 1531 - DNA, 20 bp, Artificial Sequence
  source: /note="Description of Artificial Sequence: Synthetic oligonucleotide"
actggtttcaggagctgttc

SEQ ID NO: 1532 - DNA, 20 bp, Artificial Sequence
  source: /note="Description of Artificial Sequence: Synthetic oligonucleotide"
gatgctggactctgattccc

SEQ ID NO: 1533 - DNA, 20 bp, Artificial Sequence
  source: /note="Description of Artificial Sequence: Synthetic oligonucleotide"
cttgtgacttcagctgttcc

SEQ ID NO: 1534 - DNA, 20 bp, Artificial Sequence
  source: /note="Description of Artificial Sequence: Synthetic oligonucleotide"
catacagagcccactgtggg

SEQ ID NO: 1535 - DNA, 20 bp, Artificial Sequence
  source: /note="Description of Artificial Sequence: Synthetic oligonucleotide"
gaatccttaccctctgggtg

SEQ ID NO: 1536 - DNA, 20 bp, Artificial Sequence
  source: /note="Description of Artificial Sequence: Synthetic oligonucleotide"
cttctgttgggttgttgcac

SEQ ID NO: 1537 - DNA, 20 bp, Artificial Sequence
  source: /note="Description of Artificial Sequence: Synthetic oligonucleotide"
acttctgttgggttgttgca

SEQ ID NO: 1538 - DNA, 20 bp, Artificial Sequence
  source: /note="Description of Artificial Sequence: Synthetic oligonucleotide"
ctagtatgggtggcagtcac

SEQ ID NO: 1539 - DNA, 20 bp, Artificial Sequence
  source: /note="Description of Artificial Sequence: Synthetic oligonucleotide"
ggtggaggaaggatcaggct

SEQ ID NO: 1540 - DNA, 20 bp, Artificial Sequence
  source: /note="Description of Artificial Sequence: Synthetic oligonucleotide"
tgcagatggctgcctaatcc

SEQ ID NO: 1541 - DNA, 20 bp, Artificial Sequence
  source: /note="Description of Artificial Sequence: Synthetic oligonucleotide"
cccaaactgcacagccccaa

SEQ ID NO: 1542 - DNA, 20 bp, Artificial Sequence
  source: /note="Description of Artificial Sequence: Synthetic oligonucleotide"
tgtctgagcaggctttggag

SEQ ID NO: 1543 - DNA, 20 bp, Artificial Sequence
  source: /note="Description of Artificial Sequence: Synthetic oligonucleotide"
gtgcttgacctggtgatctg

SEQ ID NO: 1544 - DNA, 20 bp, Artificial Sequence
  source: /note="Description of Artificial Sequence: Synthetic oligonucleotide"
tggtctctcacaggatgctg

SEQ ID NO: 1545 - DNA, 20 bp, Artificial Sequence
  source: /note="Description of Artificial Sequence: Synthetic oligonucleotide"
gaggatcatgccaccttgga

SEQ ID NO: 1546 - DNA, 20 bp, Artificial Sequence
  source: /note="Description of Artificial Sequence: Synthetic oligonucleotide"
ctaagggcagtgctctcttt

SEQ ID NO: 1547 - DNA, 20 bp, Artificial Sequence
  source: /note="Description of Artificial Sequence: Synthetic oligonucleotide"
tcaggagggagtgggactga

SEQ ID NO: 1548 - DNA, 20 bp, Artificial Sequence
  source: /note="Description of Artificial Sequence: Synthetic oligonucleotide"
acacactggccttggcttag

SEQ ID NO: 1549 - DNA, 20 bp, Artificial Sequence
  source: /note="Description of Artificial Sequence: Synthetic oligonucleotide"
acctggtgatctgagctgtg

SEQ ID NO: 1550 - DNA, 20 bp, Artificial Sequence
  source: /note="Description of Artificial Sequence: Synthetic oligonucleotide"
aggagagctacctggaccag

SEQ ID NO: 1551 - DNA, 20 bp, Artificial Sequence
  source: /note="Description of Artificial Sequence: Synthetic oligonucleotide"
agcctctgtctaggatctag

SEQ ID NO: 1552 - DNA, 20 bp, Artificial Sequence
  source: /note="Description of Artificial Sequence: Synthetic oligonucleotide"
tcatcccctggagatactca

SEQ ID NO: 1553 - DNA, 20 bp, Artificial Sequence
  source: /note="Description of Artificial Sequence: Synthetic oligonucleotide"
acactggccttggcttagag

SEQ ID NO: 1554 - DNA, 20 bp, Artificial Sequence
  source: /note="Description of Artificial Sequence: Synthetic oligonucleotide"
ttggcttagaggaggcttgt

SEQ ID NO: 1555 - DNA, 20 bp, Artificial Sequence
  source: /note="Description of Artificial Sequence: Synthetic oligonucleotide"
ctgtgtcacttctccagaca

SEQ ID NO: 1556 - DNA, 20 bp, Artificial Sequence
  source: /note="Description of Artificial Sequence: Synthetic oligonucleotide"
gaatagcctggccatgctga

SEQ ID NO: 1557 - DNA, 20 bp, Artificial Sequence
  source: /note="Description of Artificial Sequence: Synthetic oligonucleotide"
ctggactctgattccctcag

SEQ ID NO: 1558 - DNA, 20 bp, Artificial Sequence
  source: /note="Description of Artificial Sequence: Synthetic oligonucleotide"
acattgctgcttggcaaggc

SEQ ID NO: 1559 - DNA, 20 bp, Artificial Sequence
  source: /note="Description of Artificial Sequence: Synthetic oligonucleotide"
gggttctcctggtatatcta

SEQ ID NO: 1560 - DNA, 20 bp, Artificial Sequence
  source: /note="Description of Artificial Sequence: Synthetic oligonucleotide"
ttgcccacaatgggcagagg

SEQ ID NO: 1561 - DNA, 20 bp, Artificial Sequence
  source: /note="Description of Artificial Sequence: Synthetic oligonucleotide"
ggctaacattgctgcttggc

SEQ ID NO: 1562 - DNA, 20 bp, Artificial Sequence
  source: /note="Description of Artificial Sequence: Synthetic oligonucleotide"
tgtgaatagcctggccatgc

SEQ ID NO: 1563 - DNA, 20 bp, Artificial Sequence
  source: /note="Description of Artificial Sequence: Synthetic oligonucleotide"
gaggcttgtgacttcagctg

SEQ ID NO: 1564 - DNA, 20 bp, Artificial Sequence
  source: /note="Description of Artificial Sequence: Synthetic oligonucleotide"
gtggctggacttttgacctt

SEQ ID NO: 1565 - DNA, 20 bp, Artificial Sequence
  source: /note="Description of Artificial Sequence: Synthetic oligonucleotide"
ttagtgccagccttgggaag

SEQ ID NO: 1566 - DNA, 20 bp, Artificial Sequence
  source: /note="Description of Artificial Sequence: Synthetic oligonucleotide"
aactgcacagccccaaccag

SEQ ID NO: 1567 - DNA, 20 bp, Artificial Sequence
  source: /note="Description of Artificial Sequence: Synthetic oligonucleotide"
gaggtcctgagagaggtgac

SEQ ID NO: 1568 - DNA, 20 bp, Artificial Sequence
  source: /note="Description of Artificial Sequence: Synthetic oligonucleotide"
aggttcaggagagctacctg

SEQ ID NO: 1569 - DNA, 20 bp, Artificial Sequence
  source: /note="Description of Artificial Sequence: Synthetic oligonucleotide"
tcttctcctcccaaccagaa

SEQ ID NO: 1570 - DNA, 20 bp, Artificial Sequence
  source: /note="Description of Artificial Sequence: Synthetic oligonucleotide"
gctggatgctggactctgat

SEQ ID NO: 1571 - DNA, 20 bp, Artificial Sequence
  source: /note="Description of Artificial Sequence: Synthetic oligonucleotide"
ggaggatctggctgactcag

SEQ ID NO: 1572 - DNA, 20 bp, Artificial Sequence
  source: /note="Description of Artificial Sequence: Synthetic oligonucleotide"
ggactctgattccctcagag

SEQ ID NO: 1573 - DNA, 20 bp, Artificial Sequence
  source: /note="Description of Artificial Sequence: Synthetic oligonucleotide"
tgtagcagtcatcagccatt

SEQ ID NO: 1574 - DNA, 20 bp, Artificial Sequence
  source: /note="Description of Artificial Sequence: Synthetic oligonucleotide"
gcccacagcaggacaagcaa

SEQ ID NO: 1575 - DNA, 20 bp, Artificial Sequence
  source: /note="Description of Artificial Sequence: Synthetic oligonucleotide"
tttgcagtcagcagagcaca

SEQ ID NO: 1576 - DNA, 20 bp, Artificial Sequence
  source: /note="Description of Artificial Sequence: Synthetic oligonucleotide"
gagatacttcccacttcctc

SEQ ID NO: 1577 - DNA, 20 bp, Artificial Sequence
  source: /note="Description of Artificial Sequence: Synthetic oligonucleotide"
gacagagactctggtgccat

SEQ ID NO: 1578 - DNA, 20 bp, Artificial Sequence
  source: /note="Description of Artificial Sequence: Synthetic oligonucleotide"
cagatggctgcctaatcctc

SEQ ID NO: 1579 - DNA, 20 bp, Artificial Sequence
  source: /note="Description of Artificial Sequence: Synthetic oligonucleotide"
agctgactgctatcagcagg

SEQ ID NO: 1580 - DNA, 20 bp, Artificial Sequence
  source: /note="Description of Artificial Sequence: Synthetic oligonucleotide"
acttcccacttcctcataca

SEQ ID NO: 1581 - DNA, 20 bp, Artificial Sequence
  source: /note="Description of Artificial Sequence: Synthetic oligonucleotide"
tggcctgtgtgaatagcctg

SEQ ID NO: 1582 - DNA, 20 bp, Artificial Sequence
  source: /note="Description of Artificial Sequence: Synthetic oligonucleotide"
ctttatgccccagtctggaa

SEQ ID NO: 1583 - DNA, 20 bp, Artificial Sequence
  source: /note="Description of Artificial Sequence: Synthetic oligonucleotide"
cagtcatcagccattcctta

SEQ ID NO: 1584 - DNA, 20 bp, Artificial Sequence
  source: /note="Description of Artificial Sequence: Synthetic oligonucleotide"
aggtcctgagagaggtgaca

SEQ ID NO: 1585 - DNA, 20 bp, Artificial Sequence
  source: /note="Description of Artificial Sequence: Synthetic oligonucleotide"
tgacagagactctggtgcca

SEQ ID NO: 1586 - DNA, 20 bp, Artificial Sequence
  source: /note="Description of Artificial Sequence: Synthetic oligonucleotide"
cataacccacacaggcccac

SEQ ID NO: 1587 - DNA, 20 bp, Artificial Sequence
  source: /note="Description of Artificial Sequence: Synthetic oligonucleotide"
tggaatccttaccctctggg

SEQ ID NO: 1588 - DNA, 20 bp, Artificial Sequence
  source: /note="Description of Artificial Sequence: Synthetic oligonucleotide"
agatacttcccacttcctca

SEQ ID NO: 1589 - DNA, 20 bp, Artificial Sequence
  source: /note="Description of Artificial Sequence: Synthetic oligonucleotide"
aaagtttcctcttctcctcc

SEQ ID NO: 1590 - DNA, 20 bp, Artificial Sequence
  source: /note="Description of Artificial Sequence: Synthetic oligonucleotide"
ttgtgacttcagctgttcca

SEQ ID NO: 1591 - DNA, 20 bp, Artificial Sequence
  source: /note="Description of Artificial Sequence: Synthetic oligonucleotide"
ctggtgatctgagctgtgtt

SEQ ID NO: 1592 - DNA, 20 bp, Artificial Sequence
  source: /note="Description of Artificial Sequence: Synthetic oligonucleotide"
tcccctggagatactcagac

SEQ ID NO: 1593 - DNA, 20 bp, Artificial Sequence
  source: /note="Description of Artificial Sequence: Synthetic oligonucleotide"
ggcagaggagctatttggga

SEQ ID NO: 1594 - DNA, 20 bp, Artificial Sequence
  source: /note="Description of Artificial Sequence: Synthetic oligonucleotide"
agaggtcctgagagaggtga

SEQ ID NO: 1595 - DNA, 20 bp, Artificial Sequence
  source: /note="Description of Artificial Sequence: Synthetic oligonucleotide"
gagaggtcctgagagaggtg

SEQ ID NO: 1596 - DNA, 20 bp, Artificial Sequence
  source: /note="Description of Artificial Sequence: Synthetic oligonucleotide"
ccccagtaaatcctgtgtca

SEQ ID NO: 1597 - DNA, 20 bp, Artificial Sequence
  source: /note="Description of Artificial Sequence: Synthetic oligonucleotide"
cacaggtgctctcttttctg

SEQ ID NO: 1598 - DNA, 20 bp, Artificial Sequence
  source: /note="Description of Artificial Sequence: Synthetic oligonucleotide"
tggcttagaggaggcttgtg

SEQ ID NO: 1599 - DNA, 20 bp, Artificial Sequence
  source: /note="Description of Artificial Sequence: Synthetic oligonucleotide"
gaacacactggccttggctt

SEQ ID NO: 1600 - DNA, 20 bp, Artificial Sequence
  source: /note="Description of Artificial Sequence: Synthetic oligonucleotide"
ttctgttgggttgttgcaca

SEQ ID NO: 1601 - DNA, 20 bp, Artificial Sequence
  source: /note="Description of Artificial Sequence: Synthetic oligonucleotide"
tggactctgattccctcaga

SEQ ID NO: 1602 - DNA, 20 bp, Artificial Sequence
  source: /note="Description of Artificial Sequence: Synthetic oligonucleotide"
ggatgctggactctgattcc

SEQ ID NO: 1603 - DNA, 20 bp, Artificial Sequence
  source: /note="Description of Artificial Sequence: Synthetic oligonucleotide"
gatttgcagtcagcagagca

SEQ ID NO: 1604 - DNA, 20 bp, Artificial Sequence
  source: /note="Description of Artificial Sequence: Synthetic oligonucleotide"
ctgtggcctgtgtgaatagc

SEQ ID NO: 1605 - DNA, 20 bp, Artificial Sequence
  source: /note="Description of Artificial Sequence: Synthetic oligonucleotide"
acagacctgtgtctgagcag

SEQ ID NO: 1606 - DNA, 20 bp, Artificial Sequence
  source: /note="Description of Artificial Sequence: Synthetic oligonucleotide"
aatagcctggccatgctgac

SEQ ID NO: 1607 - DNA, 20 bp, Artificial Sequence
  source: /note="Description of Artificial Sequence: Synthetic oligonucleotide"
gatacttcccacttcctcat

SEQ ID NO: 1608 - DNA, 20 bp, Artificial Sequence
  source: /note="Description of Artificial Sequence: Synthetic oligonucleotide"
ctaatcctccaggagccatt

SEQ ID NO: 1609 - DNA, 20 bp, Artificial Sequence
  source: /note="Description of Artificial Sequence: Synthetic oligonucleotide"
ctacagacctgtgtctgagc

SEQ ID NO: 1610 - DNA, 20 bp, Artificial Sequence
  source: /note="Description of Artificial Sequence: Synthetic oligonucleotide"
gaggaggttcaggagagcta

SEQ ID NO: 1611 - DNA, 20 bp, Artificial Sequence
  source: /note="Description of Artificial Sequence: Synthetic oligonucleotide"
ttgggacaggagtcagttct

SEQ ID NO: 1612 - DNA, 20 bp, Artificial Sequence
  source: /note="Description of Artificial Sequence: Synthetic oligonucleotide"
catctttttccatctgtcct

SEQ ID NO: 1613 - DNA, 20 bp, Artificial Sequence
  source: /note="Description of Artificial Sequence: Synthetic oligonucleotide"
gggcagtggacaacagtgga

SEQ ID NO: 1614 - DNA, 20 bp, Artificial Sequence
  source: /note="Description of Artificial Sequence: Synthetic oligonucleotide"
aggagaggtcctgagagagg

SEQ ID NO: 1615 - DNA, 20 bp, Artificial Sequence
  source: /note="Description of Artificial Sequence: Synthetic oligonucleotide"
agaggatcatgccaccttgg

SEQ ID NO: 1616 - DNA, 20 bp, Artificial Sequence
  source: /note="Description of Artificial Sequence: Synthetic oligonucleotide"
tttatgtgctgggttctgtc

SEQ ID NO: 1617 - DNA, 20 bp, Artificial Sequence
  source: /note="Description of Artificial Sequence: Synthetic oligonucleotide"
ggcagtcacctctgaacaca

SEQ ID NO: 1618 - DNA, 20 bp, Artificial Sequence
  source: /note="Description of Artificial Sequence: Synthetic oligonucleotide"
ccaggagccattttccaagg

SEQ ID NO: 1619 - DNA, 20 bp, Artificial Sequence
  source: /note="Description of Artificial Sequence: Synthetic oligonucleotide"
cccacttcctcatacattct

SEQ ID NO: 1620 - DNA, 20 bp, Artificial Sequence
  source: /note="Description of Artificial Sequence: Synthetic oligonucleotide"
cttcccacttcctcatacat

SEQ ID NO: 1621 - DNA, 20 bp, Artificial Sequence
  source: /note="Description of Artificial Sequence: Synthetic oligonucleotide"
aaaccttctggtgccttggg

SEQ ID NO: 1622 - DNA, 20 bp, Artificial Sequence
  source: /note="Description of Artificial Sequence: Synthetic oligonucleotide"
cccctggagatactcagaca

SEQ ID NO: 1623 - DNA, 20 bp, Artificial Sequence
  source: /note="Description of Artificial Sequence: Synthetic oligonucleotide"
taggtgcttgacctggtgat

SEQ ID NO: 1624 - DNA, 20 bp, Artificial Sequence
  source: /note="Description of Artificial Sequence: Synthetic oligonucleotide"
gccccagtctggaaacattc

SEQ ID NO: 1625 - DNA, 20 bp, Artificial Sequence
  source: /note="Description of Artificial Sequence: Synthetic oligonucleotide"
agctgtgtttgtcctagtat

SEQ ID NO: 1626 - DNA, 20 bp, Artificial Sequence
  source: /note="Description of Artificial Sequence: Synthetic oligonucleotide"
ccatgctcataatggagccc

SEQ ID NO: 1627 - DNA, 20 bp, Artificial Sequence
  source: /note="Description of Artificial Sequence: Synthetic oligonucleotide"
cccatgctcataatggagcc

SEQ ID NO: 1628 - DNA, 20 bp, Artificial Sequence
  source: /note="Description of Artificial Sequence: Synthetic oligonucleotide"
tctgttgggttgttgcacat

SEQ ID NO: 1629 - DNA, 20 bp, Artificial Sequence
  source: /note="Description of Artificial Sequence: Synthetic oligonucleotide"
tattttccagagccatgtcc

SEQ ID NO: 1630 - DNA, 20 bp, Artificial Sequence
  source: /note="Description of Artificial Sequence: Synthetic oligonucleotide"
aaactgtgggttctcctggt

SEQ ID NO: 1631 - DNA, 20 bp, Artificial Sequence
  source: /note="Description of Artificial Sequence: Synthetic oligonucleotide"
gtgtgaatagcctggccatg

SEQ ID NO: 1632 - DNA, 20 bp, Artificial Sequence
  source: /note="Description of Artificial Sequence: Synthetic oligonucleotide"
tgtgtgaatagcctggccat

SEQ ID NO: 1633 - DNA, 20 bp, Artificial Sequence
  source: /note="Description of Artificial Sequence: Synthetic oligonucleotide"
ggatcatgccaccttggatt

SEQ ID NO: 1634 - DNA, 20 bp, Artificial Sequence
  source: /note="Description of Artificial Sequence: Synthetic oligonucleotide"
accccagtaaatcctgtgtc

SEQ ID NO: 1635 - DNA, 20 bp, Artificial Sequence
  source: /note="Description of Artificial Sequence: Synthetic oligonucleotide"
tgaacacactggccttggct

SEQ ID NO: 1636 - DNA, 20 bp, Artificial Sequence
  source: /note="Description of Artificial Sequence: Synthetic oligonucleotide"
atcccctggagatactcaga

SEQ ID NO: 1637 - DNA, 20 bp, Artificial Sequence
  source: /note="Description of Artificial Sequence: Synthetic oligonucleotide"
atcatcccctggagatactc

SEQ ID NO: 1638 - DNA, 20 bp, Artificial Sequence
  source: /note="Description of Artificial Sequence: Synthetic oligonucleotide"
gcttagaggaggcttgtgac

SEQ ID NO: 1639 - DNA, 20 bp, Artificial Sequence
  source: /note="Description of Artificial Sequence: Synthetic oligonucleotide"
tgctgtggcctgtgtgaata

SEQ ID NO: 1640 - DNA, 20 bp, Artificial Sequence
  source: /note="Description of Artificial Sequence: Synthetic oligonucleotide"
cacctctgaacacactggcc

SEQ ID NO: 1641 - DNA, 20 bp, Artificial Sequence
  source: /note="Description of Artificial Sequence: Synthetic oligonucleotide"
ctgggttctgtcagatcaca

SEQ ID NO: 1642 - DNA, 20 bp, Artificial Sequence
  source: /note="Description of Artificial Sequence: Synthetic oligonucleotide"
aggatcatgccaccttggat

SEQ ID NO: 1643 - DNA, 20 bp, Artificial Sequence
  source: /note="Description of Artificial Sequence: Synthetic oligonucleotide"
gggttccccacatgaaatcc

SEQ ID NO: 1644 - DNA, 20 bp, Artificial Sequence
  source: /note="Description of Artificial Sequence: Synthetic oligonucleotide"
aagagtgttgcctttgctgt

SEQ ID NO: 1645 - DNA, 20 bp, Artificial Sequence
  source: /note="Description of Artificial Sequence: Synthetic oligonucleotide"
tctgtctcaggagaagccag

SEQ ID NO: 1646 - DNA, 20 bp, Artificial Sequence
  source: /note="Description of Artificial Sequence: Synthetic oligonucleotide"
agccaagcagaacaccctgg

SEQ ID NO: 1647 - DNA, 20 bp, Artificial Sequence
  source: /note="Description of Artificial Sequence: Synthetic oligonucleotide"
catcctcctcaagctgactg

SEQ ID NO: 1648 - DNA, 20 bp, Artificial Sequence
  source: /note="Description of Artificial Sequence: Synthetic oligonucleotide"
catcccctggagatactcag

SEQ ID NO: 1649 - DNA, 20 bp, Artificial Sequence
  source: /note="Description of Artificial Sequence: Synthetic oligonucleotide"
tcccacttcctcatacattc

SEQ ID NO: 1650 - DNA, 20 bp, Artificial Sequence
  source: /note="Description of Artificial Sequence: Synthetic oligonucleotide"
gtggcagaggagctatttgg

SEQ ID NO: 1651 - DNA, 20 bp, Artificial Sequence
  source: /note="Description of Artificial Sequence: Synthetic oligonucleotide"
ccaagcaactggaggtctgc

SEQ ID NO: 1652 - DNA, 20 bp, Artificial Sequence
  source: /note="Description of Artificial Sequence: Synthetic oligonucleotide"
cccagaatccatgtgtcttc

SEQ ID NO: 1653 - DNA, 20 bp, Artificial Sequence
  source: /note="Description of Artificial Sequence: Synthetic oligonucleotide"
agctttgtcagctagttgtg

SEQ ID NO: 1654 - DNA, 20 bp, Artificial Sequence
  source: /note="Description of Artificial Sequence: Synthetic oligonucleotide"
gctcataatggagccctttc

SEQ ID NO: 1655 - DNA, 20 bp, Artificial Sequence
  source: /note="Description of Artificial Sequence: Synthetic oligonucleotide"
ccacacagggcagtggacaa

SEQ ID NO: 1656 - DNA, 20 bp, Artificial Sequence
  source: /note="Description of Artificial Sequence: Synthetic oligonucleotide"
cctacagacctgtgtctgag

SEQ ID NO: 1657 - DNA, 20 bp, Artificial Sequence
  source: /note="Description of Artificial Sequence: Synthetic oligonucleotide"
aatcctccaggagccatttt

SEQ ID NO: 1658 - DNA, 20 bp, Artificial Sequence
  source: /note="Description of Artificial Sequence: Synthetic oligonucleotide"
attcctggaatccttaccct

SEQ ID NO: 1659 - DNA, 20 bp, Artificial Sequence
  source: /note="Description of Artificial Sequence: Synthetic oligonucleotide"
gctgtgtttgtcctagtatg

SEQ ID NO: 1660 - DNA, 20 bp, Artificial Sequence
  source: /note="Description of Artificial Sequence: Synthetic oligonucleotide"
ttgacctggtgatctgagct

SEQ ID NO: 1661 - DNA, 20 bp, Artificial Sequence
  source: /note="Description of Artificial Sequence: Synthetic oligonucleotide"
cttgacctggtgatctgagc

SEQ ID NO: 1662 - DNA, 20 bp, Artificial Sequence
  source: /note="Description of Artificial Sequence: Synthetic oligonucleotide"
gcttgacctggtgatctgag

SEQ ID NO: 1663 - DNA, 20 bp, Artificial Sequence
  source: /note="Description of Artificial Sequence: Synthetic oligonucleotide"
gtgatctgagctgtgtttgt

SEQ ID NO: 1664 - DNA, 20 bp, Artificial Sequence
  source: /note="Description of Artificial Sequence: Synthetic oligonucleotide"
tgaatagcctggccatgctg

SEQ ID NO: 1665 - DNA, 20 bp, Artificial Sequence
  source: /note="Description of Artificial Sequence: Synthetic oligonucleotide"
acttataaccccacaggcca

SEQ ID NO: 1666 - DNA, 20 bp, Artificial Sequence
  source: /note="Description of Artificial Sequence: Synthetic oligonucleotide"
cacttataaccccacaggcc

SEQ ID NO: 1667 - DNA, 20 bp, Artificial Sequence
  source: /note="Description of Artificial Sequence: Synthetic oligonucleotide"
cttggcttagaggaggcttg

SEQ ID NO: 1668 - DNA, 20 bp, Artificial Sequence
  source: /note="Description of Artificial Sequence: Synthetic oligonucleotide"
agagagaccaaggcaccacc

SEQ ID NO: 1669 - DNA, 20 bp, Artificial Sequence
  source: /note="Description of Artificial Sequence: Synthetic oligonucleotide"
atattcctgctctgtatggc

SEQ ID NO: 1670 - DNA, 20 bp, Artificial Sequence
  source: /note="Description of Artificial Sequence: Synthetic oligonucleotide"
caccccagtaaatcctgtgt

SEQ ID NO: 1671 - DNA, 20 bp, Artificial Sequence
  source: /note="Description of Artificial Sequence: Synthetic oligonucleotide"
atttgcagtcagcagagcac

SEQ ID NO: 1672 - DNA, 20 bp, Artificial Sequence
  source: /note="Description of Artificial Sequence: Synthetic oligonucleotide"
ggaaggccaggaagctttgt

SEQ ID NO: 1673 - DNA, 20 bp, Artificial Sequence
  source: /note="Description of Artificial Sequence: Synthetic oligonucleotide"
agcttcattcctggaatcct

SEQ ID NO: 1674 - DNA, 20 bp, Artificial Sequence
  source: /note="Description of Artificial Sequence: Synthetic oligonucleotide"
gctaacattgctgcttggca

SEQ ID NO: 1675 - DNA, 20 bp, Artificial Sequence
  source: /note="Description of Artificial Sequence: Synthetic oligonucleotide"
caggagggagtgggactgat

SEQ ID NO: 1676 - DNA, 20 bp, Artificial Sequence
  source: /note="Description of Artificial Sequence: Synthetic oligonucleotide"
aaaggccacttctgagtcct

SEQ ID NO: 1677 - DNA, 20 bp, Artificial Sequence
  source: /note="Description of Artificial Sequence: Synthetic oligonucleotide"
cccacaatgggcagaggatc

SEQ ID NO: 1678 - DNA, 20 bp, Artificial Sequence
  source: /note="Description of Artificial Sequence: Synthetic oligonucleotide"
aggaggttcaggagagctac

SEQ ID NO: 1679 - DNA, 20 bp, Artificial Sequence
  source: /note="Description of Artificial Sequence: Synthetic oligonucleotide"
atgacagagactctggtgcc

SEQ ID NO: 1680 - DNA, 20 bp, Artificial Sequence
  source: /note="Description of Artificial Sequence: Synthetic oligonucleotide"
tacagacctgtgtctgagca

SEQ ID NO: 1681 - DNA, 20 bp, Artificial Sequence
  source: /note="Description of Artificial Sequence: Synthetic oligonucleotide"
gcaggctttggaggaaaggc

SEQ ID NO: 1682 - DNA, 20 bp, Artificial Sequence
  source: /note="Description of Artificial Sequence: Synthetic oligonucleotide"
gtgacacttcagggaccaga

SEQ ID NO: 1683 - DNA, 20 bp, Artificial Sequence
  source: /note="Description of Artificial Sequence: Synthetic oligonucleotide"
gggatattcctgctctgtat

SEQ ID NO: 1684 - DNA, 20 bp, Artificial Sequence
  source: /note="Description of Artificial Sequence: Synthetic oligonucleotide"
gggtcagctttttgttgcaa

SEQ ID NO: 1685 - DNA, 20 bp, Artificial Sequence
  source: /note="Description of Artificial Sequence: Synthetic oligonucleotide"
tgattgggtaatgcagggcc

SEQ ID NO: 1686 - DNA, 20 bp, Artificial Sequence
  source: /note="Description of Artificial Sequence: Synthetic oligonucleotide"
cttataaccccacaggccag

SEQ ID NO: 1687 - DNA, 20 bp, Artificial Sequence
  source: /note="Description of Artificial Sequence: Synthetic oligonucleotide"
agggaaggccaggaagcttt

SEQ ID NO: 1688 - DNA, 20 bp, Artificial Sequence
  source: /note="Description of Artificial Sequence: Synthetic oligonucleotide"
tgtgtcacttctccagacag

SEQ ID NO: 1689 - DNA, 20 bp, Artificial Sequence
  source: /note="Description of Artificial Sequence: Synthetic oligonucleotide"
tgcttgacctggtgatctga

SEQ ID NO: 1690 - DNA, 20 bp, Artificial Sequence
  source: /note="Description of Artificial Sequence: Synthetic oligonucleotide"
tcttttatgtgctgggttct

SEQ ID NO: 1691 - DNA, 20 bp, Artificial Sequence
  source: /note="Description of Artificial Sequence: Synthetic oligonucleotide"
gtgtcttcattcattcacct

SEQ ID NO: 1692 - DNA, 20 bp, Artificial Sequence
  source: /note="Description of Artificial Sequence: Synthetic oligonucleotide"
tccaggagccattttccaag

SEQ ID NO: 1693 - DNA, 20 bp, Artificial Sequence
  source: /note="Description of Artificial Sequence: Synthetic oligonucleotide"
ggctttggaggaaaggccac

SEQ ID NO: 1694 - DNA, 20 bp, Artificial Sequence
  source: /note="Description of Artificial Sequence: Synthetic oligonucleotide"
gcagaggtcaaccagaaggc

SEQ ID NO: 1695 - DNA, 20 bp, Artificial Sequence
  source: /note="Description of Artificial Sequence: Synthetic oligonucleotide"
tgacctggtgatctgagctg

SEQ ID NO: 1696 - DNA, 20 bp, Artificial Sequence
  source: /note="Description of Artificial Sequence: Synthetic oligonucleotide"
agggcagtggacaacagtgg

SEQ ID NO: 1697 - DNA, 20 bp, Artificial Sequence
  source: /note="Description of Artificial Sequence: Synthetic oligonucleotide"
ttcaggagagctacctggac

SEQ ID NO: 1698 - DNA, 20 bp, Artificial Sequence
  source: /note="Description of Artificial Sequence: Synthetic oligonucleotide"
caggagccattttccaaggg

SEQ ID NO: 1699 - DNA, 20 bp, Artificial Sequence
  source: /note="Description of Artificial Sequence: Synthetic oligonucleotide"
tgagatacttcccacttcct

SEQ ID NO: 1700 - DNA, 20 bp, Artificial Sequence
  source: /note="Description of Artificial Sequence: Synthetic oligonucleotide"
ctgagatacttcccacttcc

SEQ ID NO: 1701 - DNA, 20 bp, Artificial Sequence
  source: /note="Description of Artificial Sequence: Synthetic oligonucleotide"
ggtcaaccagaaggccacac

SEQ ID NO: 1702 - DNA, 20 bp, Artificial Sequence
  source: /note="Description of Artificial Sequence: Synthetic oligonucleotide"
gagtgtggctggacttttga

SEQ ID NO: 1703 - DNA, 20 bp, Artificial Sequence
  source: /note="Description of Artificial Sequence: Synthetic oligonucleotide"
tggcagaggagctatttggg

SEQ ID NO: 1704 - DNA, 20 bp, Artificial Sequence
  source: /note="Description of Artificial Sequence: Synthetic oligonucleotide"
tacttcccacttcctcatac

SEQ ID NO: 1705 - DNA, 20 bp, Artificial Sequence
  source: /note="Description of Artificial Sequence: Synthetic oligonucleotide"
agagccagaaatcatcccct

SEQ ID NO: 1706 - DNA, 20 bp, Artificial Sequence
  source: /note="Description of Artificial Sequence: Synthetic oligonucleotide"
taagggcagtgctctctttg

SEQ ID NO: 1707 - DNA, 20 bp, Artificial Sequence
  source: /note="Description of Artificial Sequence: Synthetic oligonucleotide"
ttcaactcactctacccagc

SEQ ID NO: 1708 - DNA, 20 bp, Artificial Sequence
  source: /note="Description of Artificial Sequence: Synthetic oligonucleotide"
gaggtcaaccagaaggccac

SEQ ID NO: 1709 - DNA, 20 bp, Artificial Sequence
  source: /note="Description of Artificial Sequence: Synthetic oligonucleotide"
gaggaggcttgtgacttcag

SEQ ID NO: 1710 - DNA, 20 bp, Artificial Sequence
  source: /note="Description of Artificial Sequence: Synthetic oligonucleotide"
agaggaggcttgtgacttca

SEQ ID NO: 1711 - DNA, 20 bp, Artificial Sequence
  source: /note="Description of Artificial Sequence: Synthetic oligonucleotide"
gacctttaatgtccctgagc

SEQ ID NO: 1712 - DNA, 20 bp, Artificial Sequence
  source: /note="Description of Artificial Sequence: Synthetic oligonucleotide"
tctgcctggaccagaagaca

SEQ ID NO: 1713 - DNA, 20 bp, Artificial Sequence
  source: /note="Description of Artificial Sequence: Synthetic oligonucleotide"
gaaaggccacttctgagtcc

SEQ ID NO: 1714 - DNA, 20 bp, Artificial Sequence
  source: /note="Description of Artificial Sequence: Synthetic oligonucleotide"
aggctttggaggaaaggcca

SEQ ID NO: 1715 - DNA, 20 bp, Artificial Sequence
  source: /note="Description of Artificial Sequence: Synthetic oligonucleotide"
caggctttggaggaaaggcc

SEQ ID NO: 1716 - DNA, 20 bp, Artificial Sequence
  source: /note="Description of Artificial Sequence: Synthetic oligonucleotide"
gggaaggccaggaagctttg

SEQ ID NO: 1717 - DNA, 20 bp, Artificial Sequence
  source: /note="Description of Artificial Sequence: Synthetic oligonucleotide"
aatggcagcttcattcctgg

SEQ ID NO: 1718 - DNA, 20 bp, Artificial Sequence
  source: /note="Description of Artificial Sequence: Synthetic oligonucleotide"
tggcagtcacctctgaacac

SEQ ID NO: 1719 - DNA, 20 bp, Artificial Sequence
  source: /note="Description of Artificial Sequence: Synthetic oligonucleotide"
ggtgatctgagctgtgtttg

SEQ ID NO: 1720 - DNA, 20 bp, Artificial Sequence
  source: /note="Description of Artificial Sequence: Synthetic oligonucleotide"
tggtgatctgagctgtgttt

SEQ ID NO: 1721 - DNA, 20 bp, Artificial Sequence
  source: /note="Description of Artificial Sequence: Synthetic oligonucleotide"
gaggagaggtcctgagagag

SEQ ID NO: 1722 - DNA, 20 bp, Artificial Sequence
  source: /note="Description of Artificial Sequence: Synthetic oligonucleotide"
ttgagggttccccacatgaa

SEQ ID NO: 1723 - DNA, 20 bp, Artificial Sequence
  source: /note="Description of Artificial Sequence: Synthetic oligonucleotide"
gactctggtgccatacagag

SEQ ID NO: 1724 - DNA, 20 bp, Artificial Sequence
  source: /note="Description of Artificial Sequence: Synthetic oligonucleotide"
agactctggtgccatacaga

SEQ ID NO: 1725 - DNA, 20 bp, Artificial Sequence
  source: /note="Description of Artificial Sequence: Synthetic oligonucleotide"
gagactctggtgccatacag

SEQ ID NO: 1726 - DNA, 20 bp, Artificial Sequence
  source: /note="Description of Artificial Sequence: Synthetic oligonucleotide"
agagactctggtgccataca

SEQ ID NO: 1727 - DNA, 20 bp, Artificial Sequence
  source: /note="Description of Artificial Sequence: Synthetic oligonucleotide"
cagagactctggtgccatac

SEQ ID NO: 1728 - DNA, 20 bp, Artificial Sequence
  source: /note="Description of Artificial Sequence: Synthetic oligonucleotide"
acagagactctggtgccata

SEQ ID NO: 1729 - DNA, 20 bp, Artificial Sequence
  source: /note="Description of Artificial Sequence: Synthetic oligonucleotide"
ttccagcccaaactgcacag

SEQ ID NO: 1730 - DNA, 20 bp, Artificial Sequence
  source: /note="Description of Artificial Sequence: Synthetic oligonucleotide"
cagaggatcatgccaccttg

SEQ ID NO: 1731 - DNA, 20 bp, Artificial Sequence
  source: /note="Description of Artificial Sequence: Synthetic oligonucleotide"
ttataaccccacaggccaga

SEQ ID NO: 1732 - DNA, 20 bp, Artificial Sequence
  source: /note="Description of Artificial Sequence: Synthetic oligonucleotide"
taatcctccaggagccattt

SEQ ID NO: 1733 - DNA, 20 bp, Artificial Sequence
  source: /note="Description of Artificial Sequence: Synthetic oligonucleotide"
aggtcaaccagaaggccaca

SEQ ID NO: 1734 - DNA, 20 bp, Artificial Sequence
  source: /note="Description of Artificial Sequence: Synthetic oligonucleotide"
cctggctgaagagtgccaat

SEQ ID NO: 1735 - DNA, 20 bp, Artificial Sequence
  source: /note="Description of Artificial Sequence: Synthetic oligonucleotide"
ctgttgggttgttgcacatt

SEQ ID NO: 1736 - DNA, 20 bp, Artificial Sequence
  source: /note="Description of Artificial Sequence: Synthetic oligonucleotide"
acctttaatgtccctgagca

SEQ ID NO: 1737 - DNA, 20 bp, Artificial Sequence
  source: /note="Description of Artificial Sequence: Synthetic oligonucleotide"
ggaggaagagtgttgccttt

SEQ ID NO: 1738 - DNA, 20 bp, Artificial Sequence
  source: /note="Description of Artificial Sequence: Synthetic oligonucleotide"
aggagggagtgggactgatt

SEQ ID NO: 1739 - DNA, 20 bp, Artificial Sequence
  source: /note="Description of Artificial Sequence: Synthetic oligonucleotide"
ctgatctgcctggaccagaa

SEQ ID NO: 1740 - DNA, 20 bp, Artificial Sequence
  source: /note="Description of Artificial Sequence: Synthetic oligonucleotide"
ttgggatttgcagtcagcag

SEQ ID NO: 1741 - DNA, 20 bp, Artificial Sequence
  source: /note="Description of Artificial Sequence: Synthetic oligonucleotide"
aaactgcacagccccaacca

SEQ ID NO: 1742 - DNA, 20 bp, Artificial Sequence
  source: /note="Description of Artificial Sequence: Synthetic oligonucleotide"
caaactgcacagccccaacc

SEQ ID NO: 1743 - DNA, 20 bp, Artificial Sequence
  source: /note="Description of Artificial Sequence: Synthetic oligonucleotide"
gagccagaaatcatcccctg

SEQ ID NO: 1744 - DNA, 20 bp, Artificial Sequence
  source: /note="Description of Artificial Sequence: Synthetic oligonucleotide"
aacacactggccttggctta

SEQ ID NO: 1745 - DNA, 20 bp, Artificial Sequence
  source: /note="Description of Artificial Sequence: Synthetic oligonucleotide"
gctatttgggacaggagtca

SEQ ID NO: 1746 - DNA, 20 bp, Artificial Sequence
  source: /note="Description of Artificial Sequence: Synthetic oligonucleotide"
agaggtcaaccagaaggcca

SEQ ID NO: 1747 - DNA, 20 bp, Artificial Sequence
  source: /note="Description of Artificial Sequence: Synthetic oligonucleotide"
cagaggtcaaccagaaggcc

SEQ ID NO: 1748 - DNA, 20 bp, Artificial Sequence
  source: /note="Description of Artificial Sequence: Synthetic oligonucleotide"
ttcccacttcctcatacatt

SEQ ID NO: 1749 - DNA, 20 bp, Artificial Sequence
  source: /note="Description of Artificial Sequence: Synthetic oligonucleotide"
ggttccccacatgaaatcca

SEQ ID NO: 1750 - DNA, 20 bp, Artificial Sequence
  source: /note="Description of Artificial Sequence: Synthetic oligonucleotide"
aaactctctctctggtctct

SEQ ID NO: 1751 - DNA, 20 bp, Artificial Sequence
  source: /note="Description of Artificial Sequence: Synthetic oligonucleotide"
gaaggccaggaagctttgtc

SEQ ID NO: 1752 - DNA, 20 bp, Artificial Sequence
  source: /note="Description of Artificial Sequence: Synthetic oligonucleotide"
tgtttgtcctagtatgggtg

SEQ ID NO: 1753 - DNA, 20 bp, Artificial Sequence
  source: /note="Description of Artificial Sequence: Synthetic oligonucleotide"
tgtgtttgtcctagtatggg

SEQ ID NO: 1754 - DNA, 20 bp, Artificial Sequence
  source: /note="Description of Artificial Sequence: Synthetic oligonucleotide"
tctctgagatacttcccact

SEQ ID NO: 1755 - DNA, 20 bp, Artificial Sequence
  source: /note="Description of Artificial Sequence: Synthetic oligonucleotide"
cagccaagcagaacaccctg

SEQ ID NO: 1756 - DNA, 20 bp, Artificial Sequence
  source: /note="Description of Artificial Sequence: Synthetic oligonucleotide"
ggttctgtcagatcacatgt

SEQ ID NO: 1757 - DNA, 20 bp, Artificial Sequence
  source: /note="Description of Artificial Sequence: Synthetic oligonucleotide"
attgcccacaatgggcagag

SEQ ID NO: 1758 - DNA, 20 bp, Artificial Sequence
  source: /note="Description of Artificial Sequence: Synthetic oligonucleotide"
tttgggacaggagtcagttc

SEQ ID NO: 1759 - DNA, 20 bp, Artificial Sequence
  source: /note="Description of Artificial Sequence: Synthetic oligonucleotide"
tgccccagtctggaaacatt

SEQ ID NO: 1760 - DNA, 20 bp, Artificial Sequence
  source: /note="Description of Artificial Sequence: Synthetic oligonucleotide"
gcagaggagctatttgggac

SEQ ID NO: 1761 - DNA, 20 bp, Artificial Sequence
  source: /note="Description of Artificial Sequence: Synthetic oligonucleotide"
gatctgcctggaccagaaga

SEQ ID NO: 1762 - DNA, 20 bp, Artificial Sequence
  source: /note="Description of Artificial Sequence: Synthetic oligonucleotide"
cctttaatgtccctgagcag

SEQ ID NO: 1763 - DNA, 20 bp, Artificial Sequence
  source: /note="Description of Artificial Sequence: Synthetic oligonucleotide"
atacttcccacttcctcata

SEQ ID NO: 1764 - DNA, 20 bp, Artificial Sequence
  source: /note="Description of Artificial Sequence: Synthetic oligonucleotide"
catgctcataatggagccct

SEQ ID NO: 1765 - DNA, 20 bp, Artificial Sequence
  source: /note="Description of Artificial Sequence: Synthetic oligonucleotide"
acagggcagtggacaacagt

SEQ ID NO: 1766 - DNA, 20 bp, Artificial Sequence
  source: /note="Description of Artificial Sequence: Synthetic oligonucleotide"
aaggccaggaagctttgtca

SEQ ID NO: 1767 - DNA, 20 bp, Artificial Sequence
  source: /note="Description of Artificial Sequence: Synthetic oligonucleotide"
agtggacaacagtggagggt

SEQ ID NO: 1768 - DNA, 20 bp, Artificial Sequence
  source: /note="Description of Artificial Sequence: Synthetic oligonucleotide"
gtgcccagagatgtcaagag

SEQ ID NO: 1769 - DNA, 20 bp, Artificial Sequence
  source: /note="Description of Artificial Sequence: Synthetic oligonucleotide"
gggagtgggactgattggag

SEQ ID NO: 1770 - DNA, 20 bp, Artificial Sequence
  source: /note="Description of Artificial Sequence: Synthetic oligonucleotide"
agggagtgggactgattgga

SEQ ID NO: 1771 - DNA, 20 bp, Artificial Sequence
  source: /note="Description of Artificial Sequence: Synthetic oligonucleotide"
gagggagtgggactgattgg

SEQ ID NO: 1772 - DNA, 20 bp, Artificial Sequence
  source: /note="Description of Artificial Sequence: Synthetic oligonucleotide"
ggagggagtgggactgattg

SEQ ID NO: 1773 - DNA, 20 bp, Artificial Sequence
  source: /note="Description of Artificial Sequence: Synthetic oligonucleotide"
agggagactggtttcaggag

SEQ ID NO: 1774 - DNA, 20 bp, Artificial Sequence
  source: /note="Description of Artificial Sequence: Synthetic oligonucleotide"
agtgtggctggacttttgac

SEQ ID NO: 1775 - DNA, 20 bp, Artificial Sequence
  source: /note="Description of Artificial Sequence: Synthetic oligonucleotide"
tggaggaagagtgttgcctt

SEQ ID NO: 1776 - DNA, 20 bp, Artificial Sequence
  source: /note="Description of Artificial Sequence: Synthetic oligonucleotide"
actcttgtctaagggcagtg

SEQ ID NO: 1777 - DNA, 20 bp, Artificial Sequence
  source: /note="Description of Artificial Sequence: Synthetic oligonucleotide"
aatgggcagaggatcatgcc

SEQ ID NO: 1778 - DNA, 20 bp, Artificial Sequence
  source: /note="Description of Artificial Sequence: Synthetic oligonucleotide"
gcagtcacctctgaacacac

SEQ ID NO: 1779 - DNA, 20 bp, Artificial Sequence
  source: /note="Description of Artificial Sequence: Synthetic oligonucleotide"
ggttctcctggtatatctat

SEQ ID NO: 1780 - DNA, 20 bp, Artificial Sequence
  source: /note="Description of Artificial Sequence: Synthetic oligonucleotide"
gcagtcagcagagcacaatt

SEQ ID NO: 1781 - DNA, 20 bp, Artificial Sequence
  source: /note="Description of Artificial Sequence: Synthetic oligonucleotide"
gagaggtgacacttcaggga

SEQ ID NO: 1782 - DNA, 20 bp, Artificial Sequence
  source: /note="Description of Artificial Sequence: Synthetic oligonucleotide"
catgccaccttggattttca

SEQ ID NO: 1783 - DNA, 20 bp, Artificial Sequence
  source: /note="Description of Artificial Sequence: Synthetic oligonucleotide"
gtggaggaaggatcaggcta

SEQ ID NO: 1784 - DNA, 20 bp, Artificial Sequence
  source: /note="Description of Artificial Sequence: Synthetic oligonucleotide"
gctaggtggaggaaggatca

SEQ ID NO: 1785 - DNA, 20 bp, Artificial Sequence
  source: /note="Description of Artificial Sequence: Synthetic oligonucleotide"
acaacagaagctgctgggct

SEQ ID NO: 1786 - DNA, 20 bp, Artificial Sequence
  source: /note="Description of Artificial Sequence: Synthetic oligonucleotide"
ctgagcaggctttggaggaa

SEQ ID NO: 1787 - DNA, 20 bp, Artificial Sequence
  source: /note="Description of Artificial Sequence: Synthetic oligonucleotide"
tcctcccaaccagaaatggc

SEQ ID NO: 1788 - DNA, 20 bp, Artificial Sequence
  source: /note="Description of Artificial Sequence: Synthetic oligonucleotide"
tgctcataatggagcccttt

SEQ ID NO: 1789 - DNA, 20 bp, Artificial Sequence
  source: /note="Description of Artificial Sequence: Synthetic oligonucleotide"
ccatctgtcctggaatgagg

SEQ ID NO: 1790 - DNA, 20 bp, Artificial Sequence
  source: /note="Description of Artificial Sequence: Synthetic oligonucleotide"
ctttaatgtccctgagcagt

SEQ ID NO: 1791 - DNA, 20 bp, Artificial Sequence
  source: /note="Description of Artificial Sequence: Synthetic oligonucleotide"
gctatcagcaggagaaggga

SEQ ID NO: 1792 - DNA, 20 bp, Artificial Sequence
  source: /note="Description of Artificial Sequence: Synthetic oligonucleotide"
tggctggacttttgaccttt

SEQ ID NO: 1793 - DNA, 20 bp, Artificial Sequence
  source: /note="Description of Artificial Sequence: Synthetic oligonucleotide"
tcttcaactcactctaccca

SEQ ID NO: 1794 - DNA, 20 bp, Artificial Sequence
  source: /note="Description of Artificial Sequence: Synthetic oligonucleotide"
tctctgaatactgcccttgg

SEQ ID NO: 1795 - DNA, 20 bp, Artificial Sequence
  source: /note="Description of Artificial Sequence: Synthetic oligonucleotide"
gcaactcttgtctaagggca

SEQ ID NO: 1796 - DNA, 20 bp, Artificial Sequence
  source: /note="Description of Artificial Sequence: Synthetic oligonucleotide"
atccaaactctctctctggt

SEQ ID NO: 1797 - DNA, 20 bp, Artificial Sequence
  source: /note="Description of Artificial Sequence: Synthetic oligonucleotide"
tgtgcccagagatgtcaaga

SEQ ID NO: 1798 - DNA, 20 bp, Artificial Sequence
  source: /note="Description of Artificial Sequence: Synthetic oligonucleotide"
tcacctctgaacacactggc

SEQ ID NO: 1799 - DNA, 20 bp, Artificial Sequence
  source: /note="Description of Artificial Sequence: Synthetic oligonucleotide"
agccatttccatcaagcttt

SEQ ID NO: 1800 - DNA, 20 bp, Artificial Sequence
  source: /note="Description of Artificial Sequence: Synthetic oligonucleotide"
gcagtggacaacagtggagg

SEQ ID NO: 1801 - DNA, 20 bp, Artificial Sequence
  source: /note="Description of Artificial Sequence: Synthetic oligonucleotide"
ggcagtggacaacagtggag

SEQ ID NO: 1802 - DNA, 20 bp, Artificial Sequence
  source: /note="Description of Artificial Sequence: Synthetic oligonucleotide"
ctcaacttctgttgggttgt

SEQ ID NO: 1803 - DNA, 20 bp, Artificial Sequence
  source: /note="Description of Artificial Sequence: Synthetic oligonucleotide"
gatcatgccaccttggattt

SEQ ID NO: 1804 - DNA, 20 bp, Artificial Sequence
  source: /note="Description of Artificial Sequence: Synthetic oligonucleotide"
ctgtgtttgtcctagtatgg

SEQ ID NO: 1805 - DNA, 20 bp, Artificial Sequence
  source: /note="Description of Artificial Sequence: Synthetic oligonucleotide"
gagttgggatttgcagtcag

SEQ ID NO: 1806 - DNA, 20 bp, Artificial Sequence
  source: /note="Description of Artificial Sequence: Synthetic oligonucleotide"
agagttgggatttgcagtca

SEQ ID NO: 1807 - DNA, 20 bp, Artificial Sequence
  source: /note="Description of Artificial Sequence: Synthetic oligonucleotide"
tctgattccctcagagagac

SEQ ID NO: 1808 - DNA, 20 bp, Artificial Sequence
  source: /note="Description of Artificial Sequence: Synthetic oligonucleotide"
gggttctgtcagatcacatg

SEQ ID NO: 1809 - DNA, 20 bp, Artificial Sequence
  source: /note="Description of Artificial Sequence: Synthetic oligonucleotide"
tgggttctgtcagatcacat

SEQ ID NO: 1810 - DNA, 20 bp, Artificial Sequence
  source: /note="Description of Artificial Sequence: Synthetic oligonucleotide"
ggaaaggccacttctgagtc

SEQ ID NO: 1811 - DNA, 20 bp, Artificial Sequence
  source: /note="Description of Artificial Sequence: Synthetic oligonucleotide"
atctgcctggaccagaagac

SEQ ID NO: 1812 - DNA, 20 bp, Artificial Sequence
  source: /note="Description of Artificial Sequence: Synthetic oligonucleotide"
tgatctgagctgtgtttgtc

SEQ ID NO: 1813 - DNA, 20 bp, Artificial Sequence
  source: /note="Description of Artificial Sequence: Synthetic oligonucleotide"
ctgactgctatcagcaggag

SEQ ID NO: 1814 - DNA, 20 bp, Artificial Sequence
  source: /note="Description of Artificial Sequence: Synthetic oligonucleotide"
caaactctctctctggtctc

SEQ ID NO: 1815 - DNA, 20 bp, Artificial Sequence
  source: /note="Description of Artificial Sequence: Synthetic oligonucleotide"
cctcccaaccagaaatggca

SEQ ID NO: 1816 - DNA, 20 bp, Artificial Sequence
  source: /note="Description of Artificial Sequence: Synthetic oligonucleotide"
cagggcagtggacaacagtg

SEQ ID NO: 1817 - DNA, 20 bp, Artificial Sequence
  source: /note="Description of Artificial Sequence: Synthetic oligonucleotide"
agctatttgggacaggagtc

SEQ ID NO: 1818 - DNA, 20 bp, Artificial Sequence
  source: /note="Description of Artificial Sequence: Synthetic oligonucleotide"
tcacttataaccccacaggc

SEQ ID NO: 1819 - DNA, 20 bp, Artificial Sequence
  source: /note="Description of Artificial Sequence: Synthetic oligonucleotide"
atgctcataatggagccctt

SEQ ID NO: 1820 - DNA, 20 bp, Artificial Sequence
  source: /note="Description of Artificial Sequence: Synthetic oligonucleotide"
ctgattgggtaatgcagggc

SEQ ID NO: 1821 - DNA, 20 bp, Artificial Sequence
  source: /note="Description of Artificial Sequence: Synthetic oligonucleotide"
tatgccccagtctggaaaca

SEQ ID NO: 1822 - DNA, 20 bp, Artificial Sequence
  source: /note="Description of Artificial Sequence: Synthetic oligonucleotide"
aacttctgttgggttgttgc

SEQ ID NO: 1823 - DNA, 20 bp, Artificial Sequence
  source: /note="Description of Artificial Sequence: Synthetic oligonucleotide"
tgcagtcagcagagcacaat

SEQ ID NO: 1824 - DNA, 20 bp, Artificial Sequence
  source: /note="Description of Artificial Sequence: Synthetic oligonucleotide"
gttgggttgttgcacatttt

SEQ ID NO: 1825 - DNA, 20 bp, Artificial Sequence
  source: /note="Description of Artificial Sequence: Synthetic oligonucleotide"
ggcagaggtcaaccagaagg

SEQ ID NO: 1826 - DNA, 20 bp, Artificial Sequence
  source: /note="Description of Artificial Sequence: Synthetic oligonucleotide"
gggcagaggtcaaccagaag

SEQ ID NO: 1827 - DNA, 20 bp, Artificial Sequence
  source: /note="Description of Artificial Sequence: Synthetic oligonucleotide"
ggctggacttttgaccttta

SEQ ID NO: 1828 - DNA, 20 bp, Artificial Sequence
  source: /note="Description of Artificial Sequence: Synthetic oligonucleotide"
cccagtaaatcctgtgtcac

SEQ ID NO: 1829 - DNA, 20 bp, Artificial Sequence
  source: /note="Description of Artificial Sequence: Synthetic oligonucleotide"
tgagtgtggctggacttttg

SEQ ID NO: 1830 - DNA, 20 bp, Artificial Sequence
  source: /note="Description of Artificial Sequence: Synthetic oligonucleotide"
agacagagggcaagaggagc

SEQ ID NO: 1831 - DNA, 20 bp, Artificial Sequence
  source: /note="Description of Artificial Sequence: Synthetic oligonucleotide"
cttagaggaggcttgtgact

SEQ ID NO: 1832 - DNA, 20 bp, Artificial Sequence
  source: /note="Description of Artificial Sequence: Synthetic oligonucleotide"
ttcttttatgtgctgggttc

SEQ ID NO: 1833 - DNA, 20 bp, Artificial Sequence
  source: /note="Description of Artificial Sequence: Synthetic oligonucleotide"
gtcatcagccattccttaac

SEQ ID NO: 1834 - DNA, 20 bp, Artificial Sequence
  source: /note="Description of Artificial Sequence: Synthetic oligonucleotide"
caccaagcaactggaggtct

SEQ ID NO: 1835 - DNA, 20 bp, Artificial Sequence
  source: /note="Description of Artificial Sequence: Synthetic oligonucleotide"
gagctatttgggacaggagt

SEQ ID NO: 1836 - DNA, 20 bp, Artificial Sequence
  source: /note="Description of Artificial Sequence: Synthetic oligonucleotide"
gtggacaacagtggagggta

SEQ ID NO: 1837 - DNA, 20 bp, Artificial Sequence
  source: /note="Description of Artificial Sequence: Synthetic oligonucleotide"
cataatggagccctttctct

SEQ ID NO: 1838 - DNA, 20 bp, Artificial Sequence
  source: /note="Description of Artificial Sequence: Synthetic oligonucleotide"
ctcataatggagccctttct

SEQ ID NO: 1839 - DNA, 20 bp, Artificial Sequence
  source: /note="Description of Artificial Sequence: Synthetic oligonucleotide"
gacaacagaagctgctgggc

SEQ ID NO: 1840 - DNA, 20 bp, Artificial Sequence
  source: /note="Description of Artificial Sequence: Synthetic oligonucleotide"
cccacagcaggacaagcaac

SEQ ID NO: 1841 - DNA, 20 bp, Artificial Sequence
  source: /note="Description of Artificial Sequence: Synthetic oligonucleotide"
ctgattccctcagagagaca

SEQ ID NO: 1842 - DNA, 20 bp, Artificial Sequence
  source: /note="Description of Artificial Sequence: Synthetic oligonucleotide"
ctttctgctatccatcactt

SEQ ID NO: 1843 - DNA, 20 bp, Artificial Sequence
  source: /note="Description of Artificial Sequence: Synthetic oligonucleotide"
caacagaagctgctgggctg

SEQ ID NO: 1844 - DNA, 20 bp, Artificial Sequence
  source: /note="Description of Artificial Sequence: Synthetic oligonucleotide"
aagctttgtcagctagttgt

SEQ ID NO: 1845 - DNA, 20 bp, Artificial Sequence
  source: /note="Description of Artificial Sequence: Synthetic oligonucleotide"
caagcaactggaggtctgca

SEQ ID NO: 1846 - DNA, 20 bp, Artificial Sequence
  source: /note="Description of Artificial Sequence: Synthetic oligonucleotide"
tcaggctaacattgctgctt

SEQ ID NO: 1847 - DNA, 20 bp, Artificial Sequence
  source: /note="Description of Artificial Sequence: Synthetic oligonucleotide"
aacctctctgaatactgccc

SEQ ID NO: 1848 - DNA, 20 bp, Artificial Sequence
  source: /note="Description of Artificial Sequence: Synthetic oligonucleotide"
ccagaatccatgtgtcttca

SEQ ID NO: 1849 - DNA, 20 bp, Artificial Sequence
  source: /note="Description of Artificial Sequence: Synthetic oligonucleotide"
gattccctcagagagacaga

SEQ ID NO: 1850 - DNA, 20 bp, Artificial Sequence
  source: /note="Description of Artificial Sequence: Synthetic oligonucleotide"
agtcatcagccattccttaa

SEQ ID NO: 1851 - DNA, 20 bp, Artificial Sequence
  source: /note="Description of Artificial Sequence: Synthetic oligonucleotide"
acccatgctcataatggagc

SEQ ID NO: 1852 - DNA, 20 bp, Artificial Sequence
  source: /note="Description of Artificial Sequence: Synthetic oligonucleotide"
ccctggagatactcagacac

SEQ ID NO: 1853 - DNA, 20 bp, Artificial Sequence
  source: /note="Description of Artificial Sequence: Synthetic oligonucleotide"
agctaggtggaggaaggatc

SEQ ID NO: 1854 - DNA, 20 bp, Artificial Sequence
  source: /note="Description of Artificial Sequence: Synthetic oligonucleotide"
ttccatctgtcctggaatga

SEQ ID NO: 1855 - DNA, 20 bp, Artificial Sequence
  source: /note="Description of Artificial Sequence: Synthetic oligonucleotide"
tgggttgttgcacattttgt

SEQ ID NO: 1856 - DNA, 20 bp, Artificial Sequence
  source: /note="Description of Artificial Sequence: Synthetic oligonucleotide"
tgttgggttgttgcacattt

SEQ ID NO: 1857 - DNA, 20 bp, Artificial Sequence
  source: /note="Description of Artificial Sequence: Synthetic oligonucleotide"
tgatctgcctggaccagaag

SEQ ID NO: 1858 - DNA, 20 bp, Artificial Sequence
  source: /note="Description of Artificial Sequence: Synthetic oligonucleotide"
tgactgctatcagcaggaga

SEQ ID NO: 1859 - DNA, 20 bp, Artificial Sequence
  source: /note="Description of Artificial Sequence: Synthetic oligonucleotide"
ccacaatgggcagaggatca

SEQ ID NO: 1860 - DNA, 20 bp, Artificial Sequence
  source: /note="Description of Artificial Sequence: Synthetic oligonucleotide"
tcataatggagccctttctc

SEQ ID NO: 1861 - DNA, 20 bp, Artificial Sequence
  source: /note="Description of Artificial Sequence: Synthetic oligonucleotide"
ctagatcagcaatgccccaa

SEQ ID NO: 1862 - DNA, 20 bp, Artificial Sequence
  source: /note="Description of Artificial Sequence: Synthetic oligonucleotide"
cccaaccagaaatggcagct

SEQ ID NO: 1863 - DNA, 20 bp, Artificial Sequence
  source: /note="Description of Artificial Sequence: Synthetic oligonucleotide"
ggagtgggactgattggaga

SEQ ID NO: 1864 - DNA, 20 bp, Artificial Sequence
  source: /note="Description of Artificial Sequence: Synthetic oligonucleotide"
tccatctgtcctggaatgag

SEQ ID NO: 1865 - DNA, 20 bp, Artificial Sequence
  source: /note="Description of Artificial Sequence: Synthetic oligonucleotide"
agagaggtgacacttcaggg

SEQ ID NO: 1866 - DNA, 20 bp, Artificial Sequence
  source: /note="Description of Artificial Sequence: Synthetic oligonucleotide"
agcaactcttgtctaagggc

SEQ ID NO: 1867 - DNA, 20 bp, Artificial Sequence
  source: /note="Description of Artificial Sequence: Synthetic oligonucleotide"
aggctaacattgctgcttgg

SEQ ID NO: 1868 - DNA, 20 bp, Artificial Sequence
  source: /note="Description of Artificial Sequence: Synthetic oligonucleotide"
tgtgtcttcattcattcacc

SEQ ID NO: 1869 - DNA, 20 bp, Artificial Sequence
  source: /note="Description of Artificial Sequence: Synthetic oligonucleotide"
gtcacctctgaacacactgg

SEQ ID NO: 1870 - DNA, 20 bp, Artificial Sequence
  source: /note="Description of Artificial Sequence: Synthetic oligonucleotide"
ttctctgagatacttcccac

SEQ ID NO: 1871 - DNA, 20 bp, Artificial Sequence
  source: /note="Description of Artificial Sequence: Synthetic oligonucleotide"
atcatgccaccttggatttt

SEQ ID NO: 1872 - DNA, 20 bp, Artificial Sequence
  source: /note="Description of Artificial Sequence: Synthetic oligonucleotide"
ctggatgctggactctgatt

SEQ ID NO: 1873 - DNA, 20 bp, Artificial Sequence
  source: /note="Description of Artificial Sequence: Synthetic oligonucleotide"
gagctaggtggaggaaggat

SEQ ID NO: 1874 - DNA, 20 bp, Artificial Sequence
  source: /note="Description of Artificial Sequence: Synthetic oligonucleotide"
tcattcctggaatccttacc

SEQ ID NO: 1875 - DNA, 20 bp, Artificial Sequence
  source: /note="Description of Artificial Sequence: Synthetic oligonucleotide"
ttatgccccagtctggaaac

SEQ ID NO: 1876 - DNA, 20 bp, Artificial Sequence
  source: /note="Description of Artificial Sequence: Synthetic oligonucleotide"
atcaggctaacattgctgct

SEQ ID NO: 1877 - DNA, 20 bp, Artificial Sequence
  source: /note="Description of Artificial Sequence: Synthetic oligonucleotide"
gtaaactgtgggttctcctg

SEQ ID NO: 1878 - DNA, 20 bp, Artificial Sequence
  source: /note="Description of Artificial Sequence: Synthetic oligonucleotide"
tgtaaactgtgggttctcct

SEQ ID NO: 1879 - DNA, 20 bp, Artificial Sequence
  source: /note="Description of Artificial Sequence: Synthetic oligonucleotide"
atttgggacaggagtcagtt

SEQ ID NO: 1880 - DNA, 20 bp, Artificial Sequence
  source: /note="Description of Artificial Sequence: Synthetic oligonucleotide"
ggagctatttgggacaggag

SEQ ID NO: 1881 - DNA, 20 bp, Artificial Sequence
  source: /note="Description of Artificial Sequence: Synthetic oligonucleotide"
aggagctatttgggacagga

SEQ ID NO: 1882 - DNA, 20 bp, Artificial Sequence
  source: /note="Description of Artificial Sequence: Synthetic oligonucleotide"
gaggagctatttgggacagg

SEQ ID NO: 1883 - DNA, 20 bp, Artificial Sequence
  source: /note="Description of Artificial Sequence: Synthetic oligonucleotide"
atcttcaactcactctaccc

SEQ ID NO: 1884 - DNA, 20 bp, Artificial Sequence
  source: /note="Description of Artificial Sequence: Synthetic oligonucleotide"
aagggaaggccaggaagctt

SEQ ID NO: 1885 - DNA, 20 bp, Artificial Sequence
  source: /note="Description of Artificial Sequence: Synthetic oligonucleotide"
ctatggcagcagaactgtgt

SEQ ID NO: 1886 - DNA, 20 bp, Artificial Sequence
  source: /note="Description of Artificial Sequence: Synthetic oligonucleotide"
ggcatcttcaactcactcta

SEQ ID NO: 1887 - DNA, 20 bp, Artificial Sequence
  source: /note="Description of Artificial Sequence: Synthetic oligonucleotide"
cttcaactcactctacccag

SEQ ID NO: 1888 - DNA, 20 bp, Artificial Sequence
  source: /note="Description of Artificial Sequence: Synthetic oligonucleotide"
caagctgactgctatcagca

SEQ ID NO: 1889 - DNA, 20 bp, Artificial Sequence
  source: /note="Description of Artificial Sequence: Synthetic oligonucleotide"
ctggctgaagagtgccaatc

SEQ ID NO: 1890 - DNA, 20 bp, Artificial Sequence
  source: /note="Description of Artificial Sequence: Synthetic oligonucleotide"
agggttccccacatgaaatc

SEQ ID NO: 1891 - DNA, 20 bp, Artificial Sequence
  source: /note="Description of Artificial Sequence: Synthetic oligonucleotide"
acacagggcagtggacaaca

SEQ ID NO: 1892 - DNA, 20 bp, Artificial Sequence
  source: /note="Description of Artificial Sequence: Synthetic oligonucleotide"
cacacagggcagtggacaac

SEQ ID NO: 1893 - DNA, 20 bp, Artificial Sequence
  source: /note="Description of Artificial Sequence: Synthetic oligonucleotide"
tttatgccccagtctggaaa

SEQ ID NO: 1894 - DNA, 20 bp, Artificial Sequence
  source: /note="Description of Artificial Sequence: Synthetic oligonucleotide"
tcccaaccagaaatggcagc

SEQ ID NO: 1895 - DNA, 20 bp, Artificial Sequence
  source: /note="Description of Artificial Sequence: Synthetic oligonucleotide"
ataatggagccctttctctt

SEQ ID NO: 1896 - DNA, 20 bp, Artificial Sequence
  source: /note="Description of Artificial Sequence: Synthetic oligonucleotide"
ttattttccagagccatgtc

SEQ ID NO: 1897 - DNA, 20 bp, Artificial Sequence
  source: /note="Description of Artificial Sequence: Synthetic oligonucleotide"
gggttgttgcacattttgta

SEQ ID NO: 1898 - DNA, 20 bp, Artificial Sequence
  source: /note="Description of Artificial Sequence: Synthetic oligonucleotide"
ttttccatctgtcctggaat

SEQ ID NO: 1899 - DNA, 20 bp, Artificial Sequence
  source: /note="Description of Artificial Sequence: Synthetic oligonucleotide"
ggatattcctgctctgtatg

SEQ ID NO: 1900 - DNA, 20 bp, Artificial Sequence
  source: /note="Description of Artificial Sequence: Synthetic oligonucleotide"
tgctatcagcaggagaaggg

SEQ ID NO: 1901 - DNA, 20 bp, Artificial Sequence
  source: /note="Description of Artificial Sequence: Synthetic oligonucleotide"
gagggttccccacatgaaat

SEQ ID NO: 1902 - DNA, 20 bp, Artificial Sequence
  source: /note="Description of Artificial Sequence: Synthetic oligonucleotide"
aggaaaggccacttctgagt

SEQ ID NO: 1903 - DNA, 20 bp, Artificial Sequence
  source: /note="Description of Artificial Sequence: Synthetic oligonucleotide"
ggctgttctgattgggtaat

SEQ ID NO: 1904 - DNA, 20 bp, Artificial Sequence
  source: /note="Description of Artificial Sequence: Synthetic oligonucleotide"
tggatgctggactctgattc

SEQ ID NO: 1905 - DNA, 20 bp, Artificial Sequence
  source: /note="Description of Artificial Sequence: Synthetic oligonucleotide"
gattctctgagatacttccc

SEQ ID NO: 1906 - DNA, 20 bp, Artificial Sequence
  source: /note="Description of Artificial Sequence: Synthetic oligonucleotide"
tgagggttccccacatgaaa

SEQ ID NO: 1907 - DNA, 20 bp, Artificial Sequence
  source: /note="Description of Artificial Sequence: Synthetic oligonucleotide"
ctgtcctggaatgaggatct

SEQ ID NO: 1908 - DNA, 20 bp, Artificial Sequence
  source: /note="Description of Artificial Sequence: Synthetic oligonucleotide"
tgcccagagatgtcaagaga

SEQ ID NO: 1909 - DNA, 20 bp, Artificial Sequence
  source: /note="Description of Artificial Sequence: Synthetic oligonucleotide"
cacagggcagtggacaacag

SEQ ID NO: 1910 - DNA, 20 bp, Artificial Sequence
  source: /note="Description of Artificial Sequence: Synthetic oligonucleotide"
attctctgagatacttccca

SEQ ID NO: 1911 - DNA, 20 bp, Artificial Sequence
  source: /note="Description of Artificial Sequence: Synthetic oligonucleotide"
gaatgtggtacctggttagt

SEQ ID NO: 1912 - DNA, 20 bp, Artificial Sequence
  source: /note="Description of Artificial Sequence: Synthetic oligonucleotide"
aatcatcccctggagatact

SEQ ID NO: 1913 - DNA, 20 bp, Artificial Sequence
  source: /note="Description of Artificial Sequence: Synthetic oligonucleotide"
gatcaggctaacattgctgc

SEQ ID NO: 1914 - DNA, 20 bp, Artificial Sequence
  source: /note="Description of Artificial Sequence: Synthetic oligonucleotide"
accaagcaactggaggtctg

SEQ ID NO: 1915 - DNA, 20 bp, Artificial Sequence
  source: /note="Description of Artificial Sequence: Synthetic oligonucleotide"
aattgcccacaatgggcaga

SEQ ID NO: 1916 - DNA, 20 bp, Artificial Sequence
  source: /note="Description of Artificial Sequence: Synthetic oligonucleotide"
cagtggacaacagtggaggg

SEQ ID NO: 1917 - DNA, 20 bp, Artificial Sequence
  source: /note="Description of Artificial Sequence: Synthetic oligonucleotide"
taaactgtgggttctcctgg

SEQ ID NO: 1918 - DNA, 20 bp, Artificial Sequence
  source: /note="Description of Artificial Sequence: Synthetic oligonucleotide"
atgagatgcctctcttcatg

SEQ ID NO: 1919 - DNA, 20 bp, Artificial Sequence
  source: /note="Description of Artificial Sequence: Synthetic oligonucleotide"
tcaacttctgttgggttgtt

SEQ ID NO: 1920 - DNA, 20 bp, Artificial Sequence
  source: /note="Description of Artificial Sequence: Synthetic oligonucleotide"
tttccatctgtcctggaatg

SEQ ID NO: 1921 - DNA, 20 bp, Artificial Sequence
  source: /note="Description of Artificial Sequence: Synthetic oligonucleotide"
atctcaacttctgttgggtt

SEQ ID NO: 1922 - DNA, 20 bp, Artificial Sequence
  source: /note="Description of Artificial Sequence: Synthetic oligonucleotide"
acaccaagcaactggaggtc

SEQ ID NO: 1923 - DNA, 20 bp, Artificial Sequence
  source: /note="Description of Artificial Sequence: Synthetic oligonucleotide"
taatggagccctttctctta

SEQ ID NO: 1924 - DNA, 20 bp, Artificial Sequence
  source: /note="Description of Artificial Sequence: Synthetic oligonucleotide"
tctcaacttctgttgggttg

SEQ ID NO: 1925 - DNA, 20 bp, Artificial Sequence
  source: /note="Description of Artificial Sequence: Synthetic oligonucleotide"
ggctgaagagtgccaatcat

SEQ ID NO: 1926 - DNA, 20 bp, Artificial Sequence
  source: /note="Description of Artificial Sequence: Synthetic oligonucleotide"
gctgactttttcctgtatga

SEQ ID NO: 1927 - DNA, 20 bp, Artificial Sequence
  source: /note="Description of Artificial Sequence: Synthetic oligonucleotide"
gctggaaaaggctgatcctc

SEQ ID NO: 1928 - DNA, 20 bp, Artificial Sequence
  source: /note="Description of Artificial Sequence: Synthetic oligonucleotide"
ttggaggaaaggccacttct

SEQ ID NO: 1929 - DNA, 20 bp, Artificial Sequence
  source: /note="Description of Artificial Sequence: Synthetic oligonucleotide"
tccatcacttataaccccac

SEQ ID NO: 1930 - DNA, 20 bp, Artificial Sequence
  source: /note="Description of Artificial Sequence: Synthetic oligonucleotide"
tctgtcctggaatgaggatc

SEQ ID NO: 1931 - DNA, 20 bp, Artificial Sequence
  source: /note="Description of Artificial Sequence: Synthetic oligonucleotide"
aactcttgtctaagggcagt

SEQ ID NO: 1932 - DNA, 20 bp, Artificial Sequence
  source: /note="Description of Artificial Sequence: Synthetic oligonucleotide"
gaatgagtgtggctggactt

SEQ ID NO: 1933 - DNA, 20 bp, Artificial Sequence
  source: /note="Description of Artificial Sequence: Synthetic oligonucleotide"
gaggaagagtgttgcctttg

SEQ ID NO: 1934 - DNA, 20 bp, Artificial Sequence
  source: /note="Description of Artificial Sequence: Synthetic oligonucleotide"
atccatgtgtcttcattcat

SEQ ID NO: 1935 - DNA, 20 bp, Artificial Sequence
  source: /note="Description of Artificial Sequence: Synthetic oligonucleotide"
cagtcacctctgaacacact

SEQ ID NO: 1936 - DNA, 20 bp, Artificial Sequence
  source: /note="Description of Artificial Sequence: Synthetic oligonucleotide"
ccacttcctcatacattcta

SEQ ID NO: 1937 - DNA, 20 bp, Artificial Sequence
  source: /note="Description of Artificial Sequence: Synthetic oligonucleotide"
ctgctatcagcaggagaagg

SEQ ID NO: 1938 - DNA, 20 bp, Artificial Sequence
  source: /note="Description of Artificial Sequence: Synthetic oligonucleotide"
gatctctggaggaagagtgt

SEQ ID NO: 1939 - DNA, 20 bp, Artificial Sequence
  source: /note="Description of Artificial Sequence: Synthetic oligonucleotide"
gtgatctctggaggaagagt

SEQ ID NO: 1940 - DNA, 20 bp, Artificial Sequence
  source: /note="Description of Artificial Sequence: Synthetic oligonucleotide"
tatttgggacaggagtcagt

SEQ ID NO: 1941 - DNA, 20 bp, Artificial Sequence
  source: /note="Description of Artificial Sequence: Synthetic oligonucleotide"
gtcctggaatgaggatctga

SEQ ID NO: 1942 - DNA, 20 bp, Artificial Sequence
  source: /note="Description of Artificial Sequence: Synthetic oligonucleotide"
ccagtaaatcctgtgtcact

SEQ ID NO: 1943 - DNA, 20 bp, Artificial Sequence
  source: /note="Description of Artificial Sequence: Synthetic oligonucleotide"
gcaggacaagcaactcttgt

SEQ ID NO: 1944 - DNA, 20 bp, Artificial Sequence
  source: /note="Description of Artificial Sequence: Synthetic oligonucleotide"
aagctgactgctatcagcag

SEQ ID NO: 1945 - DNA, 20 bp, Artificial Sequence
  source: /note="Description of Artificial Sequence: Synthetic oligonucleotide"
tgattccctcagagagacag

SEQ ID NO: 1946 - DNA, 20 bp, Artificial Sequence
  source: /note="Description of Artificial Sequence: Synthetic oligonucleotide"
ccatcacttataaccccaca

SEQ ID NO: 1947 - DNA, 20 bp, Artificial Sequence
  source: /note="Description of Artificial Sequence: Synthetic oligonucleotide"
caatgggcagaggatcatgc

SEQ ID NO: 1948 - DNA, 20 bp, Artificial Sequence
  source: /note="Description of Artificial Sequence: Synthetic oligonucleotide"
catctgtcctggaatgagga

SEQ ID NO: 1949 - DNA, 20 bp, Artificial Sequence
  source: /note="Description of Artificial Sequence: Synthetic oligonucleotide"
gagagaggtgacacttcagg

SEQ ID NO: 1950 - DNA, 20 bp, Artificial Sequence
  source: /note="Description of Artificial Sequence: Synthetic oligonucleotide"
cttggtgatctctggaggaa

SEQ ID NO: 1951 - DNA, 20 bp, Artificial Sequence
  source: /note="Description of Artificial Sequence: Synthetic oligonucleotide"
caggctaacattgctgcttg

SEQ ID NO: 1952 - DNA, 20 bp, Artificial Sequence
  source: /note="Description of Artificial Sequence: Synthetic oligonucleotide"
gaaatggcagcttcattcct

SEQ ID NO: 1953 - DNA, 20 bp, Artificial Sequence
  source: /note="Description of Artificial Sequence: Synthetic oligonucleotide"
tggaggaaaggccacttctg

SEQ ID NO: 1954 - DNA, 20 bp, Artificial Sequence
  source: /note="Description of Artificial Sequence: Synthetic oligonucleotide"
ggaaaaggctgatcctcacc

SEQ ID NO: 1955 - DNA, 20 bp, Artificial Sequence
  source: /note="Description of Artificial Sequence: Synthetic oligonucleotide"
agcaggctttggaggaaagg

SEQ ID NO: 1956 - DNA, 20 bp, Artificial Sequence
  source: /note="Description of Artificial Sequence: Synthetic oligonucleotide"
tgaatgagtgtggctggact

SEQ ID NO: 1957 - DNA, 20 bp, Artificial Sequence
  source: /note="Description of Artificial Sequence: Synthetic oligonucleotide"
tcatcagccattccttaaca

SEQ ID NO: 1958 - DNA, 20 bp, Artificial Sequence
  source: /note="Description of Artificial Sequence: Synthetic oligonucleotide"
atccatcacttataacccca

SEQ ID NO: 1959 - DNA, 20 bp, Artificial Sequence
  source: /note="Description of Artificial Sequence: Synthetic oligonucleotide"
aaagaacagcttctccagcc

SEQ ID NO: 1960 - DNA, 20 bp, Artificial Sequence
  source: /note="Description of Artificial Sequence: Synthetic oligonucleotide"
cagaggagctatttgggaca

SEQ ID NO: 1961 - DNA, 20 bp, Artificial Sequence
  source: /note="Description of Artificial Sequence: Synthetic oligonucleotide"
cctctgtctaggatctagaa

SEQ ID NO: 1962 - DNA, 20 bp, Artificial Sequence
  source: /note="Description of Artificial Sequence: Synthetic oligonucleotide"
caatgagatgcctctcttca

SEQ ID NO: 1963 - DNA, 20 bp, Artificial Sequence
  source: /note="Description of Artificial Sequence: Synthetic oligonucleotide"
gaagctttgtcagctagttg

SEQ ID NO: 1964 - DNA, 20 bp, Artificial Sequence
  source: /note="Description of Artificial Sequence: Synthetic oligonucleotide"
ggtgatctctggaggaagag

SEQ ID NO: 1965 - DNA, 20 bp, Artificial Sequence
  source: /note="Description of Artificial Sequence: Synthetic oligonucleotide"
ttgtaaactgtgggttctcc

SEQ ID NO: 1966 - DNA, 20 bp, Artificial Sequence
  source: /note="Description of Artificial Sequence: Synthetic oligonucleotide"
aagagccagaaatcatcccc

SEQ ID NO: 1967 - DNA, 20 bp, Artificial Sequence
  source: /note="Description of Artificial Sequence: Synthetic oligonucleotide"
tgtcttcattcattcaccta

SEQ ID NO: 1968 - DNA, 20 bp, Artificial Sequence
  source: /note="Description of Artificial Sequence: Synthetic oligonucleotide"
atggcagcagaactgtgtta

SEQ ID NO: 1969 - DNA, 20 bp, Artificial Sequence
  source: /note="Description of Artificial Sequence: Synthetic oligonucleotide"
tatggcagcagaactgtgtt

SEQ ID NO: 1970 - DNA, 20 bp, Artificial Sequence
  source: /note="Description of Artificial Sequence: Synthetic oligonucleotide"
aaaaggctgatcctcacctc

SEQ ID NO: 1971 - DNA, 20 bp, Artificial Sequence
  source: /note="Description of Artificial Sequence: Synthetic oligonucleotide"
gttctgtcagatcacatgta

SEQ ID NO: 1972 - DNA, 20 bp, Artificial Sequence
  source: /note="Description of Artificial Sequence: Synthetic oligonucleotide"
aatgagtgtggctggacttt

SEQ ID NO: 1973 - DNA, 20 bp, Artificial Sequence
  source: /note="Description of Artificial Sequence: Synthetic oligonucleotide"
aggatcaggctaacattgct

SEQ ID NO: 1974 - DNA, 20 bp, Artificial Sequence
  source: /note="Description of Artificial Sequence: Synthetic oligonucleotide"
tctgattgggtaatgcaggg

SEQ ID NO: 1975 - DNA, 20 bp, Artificial Sequence
  source: /note="Description of Artificial Sequence: Synthetic oligonucleotide"
cagaaatcatcccctggaga

SEQ ID NO: 1976 - DNA, 20 bp, Artificial Sequence
  source: /note="Description of Artificial Sequence: Synthetic oligonucleotide"
gactgctatcagcaggagaa

SEQ ID NO: 1977 - DNA, 20 bp, Artificial Sequence
  source: /note="Description of Artificial Sequence: Synthetic oligonucleotide"
gagtgggactgattggagac

SEQ ID NO: 1978 - DNA, 20 bp, Artificial Sequence
  source: /note="Description of Artificial Sequence: Synthetic oligonucleotide"
gaaaaggctgatcctcacct

SEQ ID NO: 1979 - DNA, 20 bp, Artificial Sequence
  source: /note="Description of Artificial Sequence: Synthetic oligonucleotide"
cttcattcctggaatcctta

SEQ ID NO: 1980 - DNA, 20 bp, Artificial Sequence
  source: /note="Description of Artificial Sequence: Synthetic oligonucleotide"
acagagggcaagaggagcaa

SEQ ID NO: 1981 - DNA, 20 bp, Artificial Sequence
  source: /note="Description of Artificial Sequence: Synthetic oligonucleotide"
ctttggaggaaaggccactt

SEQ ID NO: 1982 - DNA, 20 bp, Artificial Sequence
  source: /note="Description of Artificial Sequence: Synthetic oligonucleotide"
tcaagagagaccaaggcacc

SEQ ID NO: 1983 - DNA, 20 bp, Artificial Sequence
  source: /note="Description of Artificial Sequence: Synthetic oligonucleotide"
tggtgatctctggaggaaga

SEQ ID NO: 1984 - DNA, 20 bp, Artificial Sequence
  source: /note="Description of Artificial Sequence: Synthetic oligonucleotide"
ttgacctttaatgtccctga

SEQ ID NO: 1985 - DNA, 20 bp, Artificial Sequence
  source: /note="Description of Artificial Sequence: Synthetic oligonucleotide"
gtgttaaagggaaggccagg

SEQ ID NO: 1986 - DNA, 20 bp, Artificial Sequence
  source: /note="Description of Artificial Sequence: Synthetic oligonucleotide"
atctctggaggaagagtgtt

SEQ ID NO: 1987 - DNA, 20 bp, Artificial Sequence
  source: /note="Description of Artificial Sequence: Synthetic oligonucleotide"
atgccaccttggattttcaa

SEQ ID NO: 1988 - DNA, 20 bp, Artificial Sequence
  source: /note="Description of Artificial Sequence: Synthetic oligonucleotide"
tttctgctatccatcactta

SEQ ID NO: 1989 - DNA, 20 bp, Artificial Sequence
  source: /note="Description of Artificial Sequence: Synthetic oligonucleotide"
agtgggactgattggagaca

SEQ ID NO: 1990 - DNA, 20 bp, Artificial Sequence
  source: /note="Description of Artificial Sequence: Synthetic oligonucleotide"
aatgtggtacctggttagtg

SEQ ID NO: 1991 - DNA, 20 bp, Artificial Sequence
  source: /note="Description of Artificial Sequence: Synthetic oligonucleotide"
tccatcaagctttcatcaga

SEQ ID NO: 1992 - DNA, 20 bp, Artificial Sequence
  source: /note="Description of Artificial Sequence: Synthetic oligonucleotide"
tgacctttaatgtccctgag

SEQ ID NO: 1993 - DNA, 20 bp, Artificial Sequence
  source: /note="Description of Artificial Sequence: Synthetic oligonucleotide"
gttctcctggtatatctata

SEQ ID NO: 1994 - DNA, 20 bp, Artificial Sequence
  source: /note="Description of Artificial Sequence: Synthetic oligonucleotide"
gaggtagtcaagagagacca

SEQ ID NO: 1995 - DNA, 20 bp, Artificial Sequence
  source: /note="Description of Artificial Sequence: Synthetic oligonucleotide"
acaatgagatgcctctcttc

SEQ ID NO: 1996 - DNA, 20 bp, Artificial Sequence
  source: /note="Description of Artificial Sequence: Synthetic oligonucleotide"
ctcccaaccagaaatggcag

SEQ ID NO: 1997 - DNA, 20 bp, Artificial Sequence
  source: /note="Description of Artificial Sequence: Synthetic oligonucleotide"
gcatcttcaactcactctac

SEQ ID NO: 1998 - DNA, 20 bp, Artificial Sequence
  source: /note="Description of Artificial Sequence: Synthetic oligonucleotide"
ctgagagaggtgacacttca

SEQ ID NO: 1999 - DNA, 20 bp, Artificial Sequence
  source: /note="Description of Artificial Sequence: Synthetic oligonucleotide"
caagagagaccaaggcacca

SEQ ID NO: 2000 - DNA, 20 bp, Artificial Sequence
  source: /note="Description of Artificial Sequence: Synthetic oligonucleotide"
ggatcaggctaacattgctg

SEQ ID NO: 2001 - DNA, 20 bp, Artificial Sequence
  source: /note="Description of Artificial Sequence: Synthetic oligonucleotide"
agtcacctctgaacacactg

SEQ ID NO: 2002 - DNA, 20 bp, Artificial Sequence
  source: /note="Description of Artificial Sequence: Synthetic oligonucleotide"
atggagccctttctcttaaa

SEQ ID NO: 2003 - DNA, 20 bp, Artificial Sequence
  source: /note="Description of Artificial Sequence: Synthetic oligonucleotide"
aatggagccctttctcttaa

SEQ ID NO: 2004 - DNA, 20 bp, Artificial Sequence
  source: /note="Description of Artificial Sequence: Synthetic oligonucleotide"
tgctggaaaaggctgatcct

SEQ ID NO: 2005 - DNA, 20 bp, Artificial Sequence
  source: /note="Description of Artificial Sequence: Synthetic oligonucleotide"
caacttctgttgggttgttg

SEQ ID NO: 2006 - DNA, 20 bp, Artificial Sequence
  source: /note="Description of Artificial Sequence: Synthetic oligonucleotide"
tttggaggaaaggccacttc

SEQ ID NO: 2007 - DNA, 20 bp, Artificial Sequence
  source: /note="Description of Artificial Sequence: Synthetic oligonucleotide"
atctgtcctggaatgaggat

SEQ ID NO: 2008 - DNA, 20 bp, Artificial Sequence
  source: /note="Description of Artificial Sequence: Synthetic oligonucleotide"
ttctgctatccatcacttat

SEQ ID NO: 2009 - DNA, 20 bp, Artificial Sequence
  source: /note="Description of Artificial Sequence: Synthetic oligonucleotide"
ggtcagctttttgttgcaaa

SEQ ID NO: 2010 - DNA, 20 bp, Artificial Sequence
  source: /note="Description of Artificial Sequence: Synthetic oligonucleotide"
agaggagctatttgggacag

SEQ ID NO: 2011 - DNA, 20 bp, Artificial Sequence
  source: /note="Description of Artificial Sequence: Synthetic oligonucleotide"
gcccagagatgtcaagagaa

SEQ ID NO: 2012 - DNA, 20 bp, Artificial Sequence
  source: /note="Description of Artificial Sequence: Synthetic oligonucleotide"
ttttgacctttaatgtccct

SEQ ID NO: 2013 - DNA, 20 bp, Artificial Sequence
  source: /note="Description of Artificial Sequence: Synthetic oligonucleotide"
cttttgacctttaatgtccc

SEQ ID NO: 2014 - DNA, 20 bp, Artificial Sequence
  source: /note="Description of Artificial Sequence: Synthetic oligonucleotide"
tgtcctggaatgaggatctg

SEQ ID NO: 2015 - DNA, 20 bp, Artificial Sequence
  source: /note="Description of Artificial Sequence: Synthetic oligonucleotide"
gtcaagagagaccaaggcac

SEQ ID NO: 2016 - DNA, 20 bp, Artificial Sequence
  source: /note="Description of Artificial Sequence: Synthetic oligonucleotide"
tcagcaggagaagggaatgc

SEQ ID NO: 2017 - DNA, 20 bp, Artificial Sequence
  source: /note="Description of Artificial Sequence: Synthetic oligonucleotide"
gcaatgccccaaattgttga

SEQ ID NO: 2018 - DNA, 20 bp, Artificial Sequence
  source: /note="Description of Artificial Sequence: Synthetic oligonucleotide"
gttccccacatgaaatccaa

SEQ ID NO: 2019 - DNA, 20 bp, Artificial Sequence
  source: /note="Description of Artificial Sequence: Synthetic oligonucleotide"
gagcaggctttggaggaaag

SEQ ID NO: 2020 - DNA, 20 bp, Artificial Sequence
  source: /note="Description of Artificial Sequence: Synthetic oligonucleotide"
catcttcaactcactctacc

SEQ ID NO: 2021 - DNA, 20 bp, Artificial Sequence
  source: /note="Description of Artificial Sequence: Synthetic oligonucleotide"
tggacaacagtggagggtat

SEQ ID NO: 2022 - DNA, 20 bp, Artificial Sequence
  source: /note="Description of Artificial Sequence: Synthetic oligonucleotide"
aaatggcagcttcattcctg

SEQ ID NO: 2023 - DNA, 20 bp, Artificial Sequence
  source: /note="Description of Artificial Sequence: Synthetic oligonucleotide"
gagggcaagaggagcaaagt

SEQ ID NO: 2024 - DNA, 20 bp, Artificial Sequence
  source: /note="Description of Artificial Sequence: Synthetic oligonucleotide"
cagcaggacaagcaactctt

SEQ ID NO: 2025 - DNA, 20 bp, Artificial Sequence
  source: /note="Description of Artificial Sequence: Synthetic oligonucleotide"
ttgggttgttgcacattttg

SEQ ID NO: 2026 - DNA, 20 bp, Artificial Sequence
  source: /note="Description of Artificial Sequence: Synthetic oligonucleotide"
actatggcagcagaactgtg

SEQ ID NO: 2027 - DNA, 20 bp, Artificial Sequence
  source: /note="Description of Artificial Sequence: Synthetic oligonucleotide"
aatgagatgcctctcttcat

SEQ ID NO: 2028 - DNA, 20 bp, Artificial Sequence
  source: /note="Description of Artificial Sequence: Synthetic oligonucleotide"
gaaattgcccacaatgggca

SEQ ID NO: 2029 - DNA, 20 bp, Artificial Sequence
  source: /note="Description of Artificial Sequence: Synthetic oligonucleotide"
aagagagaccaaggcaccac

SEQ ID NO: 2030 - DNA, 20 bp, Artificial Sequence
  source: /note="Description of Artificial Sequence: Synthetic oligonucleotide"
cagcaggagaagggaatgca

SEQ ID NO: 2031 - DNA, 20 bp, Artificial Sequence
  source: /note="Description of Artificial Sequence: Synthetic oligonucleotide"
ccaaccagaaatggcagctt

SEQ ID NO: 2032 - DNA, 20 bp, Artificial Sequence
  source: /note="Description of Artificial Sequence: Synthetic oligonucleotide"
tctgtcagatcacatgtact

SEQ ID NO: 2033 - DNA, 20 bp, Artificial Sequence
  source: /note="Description of Artificial Sequence: Synthetic oligonucleotide"
tttgacctttaatgtccctg

SEQ ID NO: 2034 - DNA, 20 bp, Artificial Sequence
  source: /note="Description of Artificial Sequence: Synthetic oligonucleotide"
caactcttgtctaagggcag

SEQ ID NO: 2035 - DNA, 20 bp, Artificial Sequence
  source: /note="Description of Artificial Sequence: Synthetic oligonucleotide"
gatcagcaatgccccaaatt

SEQ ID NO: 2036 - DNA, 20 bp, Artificial Sequence
  source: /note="Description of Artificial Sequence: Synthetic oligonucleotide"
ctgtgttaaagggaaggcca

SEQ ID NO: 2037 - DNA, 20 bp, Artificial Sequence
  source: /note="Description of Artificial Sequence: Synthetic oligonucleotide"
cctgaacccatgctcataat

SEQ ID NO: 2038 - DNA, 20 bp, Artificial Sequence
  source: /note="Description of Artificial Sequence: Synthetic oligonucleotide"
tttccatcaagctttcatca

SEQ ID NO: 2039 - DNA, 20 bp, Artificial Sequence
  source: /note="Description of Artificial Sequence: Synthetic oligonucleotide"
gctgaagagtgccaatcatt

SEQ ID NO: 2040 - DNA, 20 bp, Artificial Sequence
  source: /note="Description of Artificial Sequence: Synthetic oligonucleotide"
gggcaagaggagcaaagtga

SEQ ID NO: 2041 - DNA, 20 bp, Artificial Sequence
  source: /note="Description of Artificial Sequence: Synthetic oligonucleotide"
ccatcaagctttcatcagac

SEQ ID NO: 2042 - DNA, 20 bp, Artificial Sequence
  source: /note="Description of Artificial Sequence: Synthetic oligonucleotide"
tatccatcacttataacccc

SEQ ID NO: 2043 - DNA, 20 bp, Artificial Sequence
  source: /note="Description of Artificial Sequence: Synthetic oligonucleotide"
agatcagcaatgccccaaat

SEQ ID NO: 2044 - DNA, 20 bp, Artificial Sequence
  source: /note="Description of Artificial Sequence: Synthetic oligonucleotide"
aggacaagcaactcttgtct

SEQ ID NO: 2045 - DNA, 20 bp, Artificial Sequence
  source: /note="Description of Artificial Sequence: Synthetic oligonucleotide"
gaatccatgtgtcttcattc

SEQ ID NO: 2046 - DNA, 20 bp, Artificial Sequence
  source: /note="Description of Artificial Sequence: Synthetic oligonucleotide"
ttccatcaagctttcatcag

SEQ ID NO: 2047 - DNA, 20 bp, Artificial Sequence
  source: /note="Description of Artificial Sequence: Synthetic oligonucleotide"
atcacttataaccccacagg

SEQ ID NO: 2048 - DNA, 20 bp, Artificial Sequence
  source: /note="Description of Artificial Sequence: Synthetic oligonucleotide"
gatggaactatggcagcaga

SEQ ID NO: 2049 - DNA, 20 bp, Artificial Sequence
  source: /note="Description of Artificial Sequence: Synthetic oligonucleotide"
ggacaacagtggagggtata

SEQ ID NO: 2050 - DNA, 20 bp, Artificial Sequence
  source: /note="Description of Artificial Sequence: Synthetic oligonucleotide"
ctgttctgattgggtaatgc

SEQ ID NO: 2051 - DNA, 20 bp, Artificial Sequence
  source: /note="Description of Artificial Sequence: Synthetic oligonucleotide"
gctgttctgattgggtaatg

SEQ ID NO: 2052 - DNA, 20 bp, Artificial Sequence
  source: /note="Description of Artificial Sequence: Synthetic oligonucleotide"
cccagtctggaaacattcat

SEQ ID NO: 2053 - DNA, 20 bp, Artificial Sequence
  source: /note="Description of Artificial Sequence: Synthetic oligonucleotide"
aatccatgtgtcttcattca

SEQ ID NO: 2054 - DNA, 20 bp, Artificial Sequence
  source: /note="Description of Artificial Sequence: Synthetic oligonucleotide"
attccctcagagagacagaa

SEQ ID NO: 2055 - DNA, 20 bp, Artificial Sequence
  source: /note="Description of Artificial Sequence: Synthetic oligonucleotide"
agacaacagaagctgctggg

SEQ ID NO: 2056 - DNA, 20 bp, Artificial Sequence
  source: /note="Description of Artificial Sequence: Synthetic oligonucleotide"
ttcattcctggaatccttac

SEQ ID NO: 2057 - DNA, 20 bp, Artificial Sequence
  source: /note="Description of Artificial Sequence: Synthetic oligonucleotide"
aatctcaacttctgttgggt

SEQ ID NO: 2058 - DNA, 20 bp, Artificial Sequence
  source: /note="Description of Artificial Sequence: Synthetic oligonucleotide"
atgaatgagtgtggctggac

SEQ ID NO: 2059 - DNA, 20 bp, Artificial Sequence
  source: /note="Description of Artificial Sequence: Synthetic oligonucleotide"
gccaccttggattttcaaac

SEQ ID NO: 2060 - DNA, 20 bp, Artificial Sequence
  source: /note="Description of Artificial Sequence: Synthetic oligonucleotide"
cacaatgggcagaggatcat

SEQ ID NO: 2061 - DNA, 20 bp, Artificial Sequence
  source: /note="Description of Artificial Sequence: Synthetic oligonucleotide"
cagaatccatgtgtcttcat

SEQ ID NO: 2062 - DNA, 20 bp, Artificial Sequence
  source: /note="Description of Artificial Sequence: Synthetic oligonucleotide"
ccctcagagagacagaagat

SEQ ID NO: 2063 - DNA, 20 bp, Artificial Sequence
  source: /note="Description of Artificial Sequence: Synthetic oligonucleotide"
gctgattctctgagatactt

SEQ ID NO: 2064 - DNA, 20 bp, Artificial Sequence
  source: /note="Description of Artificial Sequence: Synthetic oligonucleotide"
gagccctttctcttaaaagt

SEQ ID NO: 2065 - DNA, 20 bp, Artificial Sequence
  source: /note="Description of Artificial Sequence: Synthetic oligonucleotide"
agcaatgccccaaattgttg

SEQ ID NO: 2066 - DNA, 20 bp, Artificial Sequence
  source: /note="Description of Artificial Sequence: Synthetic oligonucleotide"
ctaacattgctgcttggcaa

SEQ ID NO: 2067 - DNA, 20 bp, Artificial Sequence
  source: /note="Description of Artificial Sequence: Synthetic oligonucleotide"
ggaggaaggatcaggctaac

SEQ ID NO: 2068 - DNA, 20 bp, Artificial Sequence
  source: /note="Description of Artificial Sequence: Synthetic oligonucleotide"
actgtgttaaagggaaggcc

SEQ ID NO: 2069 - DNA, 20 bp, Artificial Sequence
  source: /note="Description of Artificial Sequence: Synthetic oligonucleotide"
gttctgattgggtaatgcag

SEQ ID NO: 2070 - DNA, 20 bp, Artificial Sequence
  source: /note="Description of Artificial Sequence: Synthetic oligonucleotide"
cagtcagcagagcacaatta

SEQ ID NO: 2071 - DNA, 20 bp, Artificial Sequence
  source: /note="Description of Artificial Sequence: Synthetic oligonucleotide"
agctgattctctgagatact

SEQ ID NO: 2072 - DNA, 20 bp, Artificial Sequence
  source: /note="Description of Artificial Sequence: Synthetic oligonucleotide"
ctggaaaaggctgatcctca

SEQ ID NO: 2073 - DNA, 20 bp, Artificial Sequence
  source: /note="Description of Artificial Sequence: Synthetic oligonucleotide"
tgttaaagggaaggccagga

SEQ ID NO: 2074 - DNA, 20 bp, Artificial Sequence
  source: /note="Description of Artificial Sequence: Synthetic oligonucleotide"
aaattgcccacaatgggcag

SEQ ID NO: 2075 - DNA, 20 bp, Artificial Sequence
  source: /note="Description of Artificial Sequence: Synthetic oligonucleotide"
gaaatcatcccctggagata

SEQ ID NO: 2076 - DNA, 20 bp, Artificial Sequence
  source: /note="Description of Artificial Sequence: Synthetic oligonucleotide"
caggacaagcaactcttgtc

SEQ ID NO: 2077 - DNA, 20 bp, Artificial Sequence
  source: /note="Description of Artificial Sequence: Synthetic oligonucleotide"
agcaggagaagggaatgcag

SEQ ID NO: 2078 - DNA, 20 bp, Artificial Sequence
  source: /note="Description of Artificial Sequence: Synthetic oligonucleotide"
ggacaagcaactcttgtcta

SEQ ID NO: 2079 - DNA, 20 bp, Artificial Sequence
  source: /note="Description of Artificial Sequence: Synthetic oligonucleotide"
cttagctgattctctgagat

SEQ ID NO: 2080 - DNA, 20 bp, Artificial Sequence
  source: /note="Description of Artificial Sequence: Synthetic oligonucleotide"
gtcttcattcattcacctaa

SEQ ID NO: 2081 - DNA, 20 bp, Artificial Sequence
  source: /note="Description of Artificial Sequence: Synthetic oligonucleotide"
tgttctgattgggtaatgca

SEQ ID NO: 2082 - DNA, 20 bp, Artificial Sequence
  source: /note="Description of Artificial Sequence: Synthetic oligonucleotide"
ggaactatggcagcagaact

SEQ ID NO: 2083 - DNA, 20 bp, Artificial Sequence
  source: /note="Description of Artificial Sequence: Synthetic oligonucleotide"
tgaatgtggtacctggttag

SEQ ID NO: 2084 - DNA, 20 bp, Artificial Sequence
  source: /note="Description of Artificial Sequence: Synthetic oligonucleotide"
tttctgtgaaattgcccaca

SEQ ID NO: 2085 - DNA, 20 bp, Artificial Sequence
  source: /note="Description of Artificial Sequence: Synthetic oligonucleotide"
tgaaattgcccacaatgggc

SEQ ID NO: 2086 - DNA, 20 bp, Artificial Sequence
  source: /note="Description of Artificial Sequence: Synthetic oligonucleotide"
gaatcataacccacacaggc

SEQ ID NO: 2087 - DNA, 20 bp, Artificial Sequence
  source: /note="Description of Artificial Sequence: Synthetic oligonucleotide"
agcaggacaagcaactcttg

SEQ ID NO: 2088 - DNA, 20 bp, Artificial Sequence
  source: /note="Description of Artificial Sequence: Synthetic oligonucleotide"
gctggacttttgacctttaa

SEQ ID NO: 2089 - DNA, 20 bp, Artificial Sequence
  source: /note="Description of Artificial Sequence: Synthetic oligonucleotide"
tgccaccttggattttcaaa

SEQ ID NO: 2090 - DNA, 20 bp, Artificial Sequence
  source: /note="Description of Artificial Sequence: Synthetic oligonucleotide"
tgagagaggtgacacttcag

SEQ ID NO: 2091 - DNA, 20 bp, Artificial Sequence
  source: /note="Description of Artificial Sequence: Synthetic oligonucleotide"
ggagccctttctcttaaaag

SEQ ID NO: 2092 - DNA, 20 bp, Artificial Sequence
  source: /note="Description of Artificial Sequence: Synthetic oligonucleotide"
agggcaagaggagcaaagtg

SEQ ID NO: 2093 - DNA, 20 bp, Artificial Sequence
  source: /note="Description of Artificial Sequence: Synthetic oligonucleotide"
ctgtcagatcacatgtactt

SEQ ID NO: 2094 - DNA, 20 bp, Artificial Sequence
  source: /note="Description of Artificial Sequence: Synthetic oligonucleotide"
ttctgattgggtaatgcagg

SEQ ID NO: 2095 - DNA, 20 bp, Artificial Sequence
  source: /note="Description of Artificial Sequence: Synthetic oligonucleotide"
atgaatgtggtacctggtta

SEQ ID NO: 2096 - DNA, 20 bp, Artificial Sequence
  source: /note="Description of Artificial Sequence: Synthetic oligonucleotide"
aacaccaagcaactggaggt

SEQ ID NO: 2097 - DNA, 20 bp, Artificial Sequence
  source: /note="Description of Artificial Sequence: Synthetic oligonucleotide"
acttcctcatacattctaca

SEQ ID NO: 2098 - DNA, 20 bp, Artificial Sequence
  source: /note="Description of Artificial Sequence: Synthetic oligonucleotide"
cacttcctcatacattctac

SEQ ID NO: 2099 - DNA, 20 bp, Artificial Sequence
  source: /note="Description of Artificial Sequence: Synthetic oligonucleotide"
atgctggaaaaggctgatcc

SEQ ID NO: 2100 - DNA, 20 bp, Artificial Sequence
  source: /note="Description of Artificial Sequence: Synthetic oligonucleotide"
agatggaactatggcagcag

SEQ ID NO: 2101 - DNA, 20 bp, Artificial Sequence
  source: /note="Description of Artificial Sequence: Synthetic oligonucleotide"
tggaggaaggatcaggctaa

SEQ ID NO: 2102 - DNA, 20 bp, Artificial Sequence
  source: /note="Description of Artificial Sequence: Synthetic oligonucleotide"
tcctggaatgaggatctgat

SEQ ID NO: 2103 - DNA, 20 bp, Artificial Sequence
  source: /note="Description of Artificial Sequence: Synthetic oligonucleotide"
aaacaaaccttctggtgcct

SEQ ID NO: 2104 - DNA, 20 bp, Artificial Sequence
  source: /note="Description of Artificial Sequence: Synthetic oligonucleotide"
atttccatcaagctttcatc

SEQ ID NO: 2105 - DNA, 20 bp, Artificial Sequence
  source: /note="Description of Artificial Sequence: Synthetic oligonucleotide"
agtaaatcctgtgtcacttc

SEQ ID NO: 2106 - DNA, 20 bp, Artificial Sequence
  source: /note="Description of Artificial Sequence: Synthetic oligonucleotide"
aatccaaactctctctctgg

SEQ ID NO: 2107 - DNA, 20 bp, Artificial Sequence
  source: /note="Description of Artificial Sequence: Synthetic oligonucleotide"
gccctttctcttaaaagttt

SEQ ID NO: 2108 - DNA, 20 bp, Artificial Sequence
  source: /note="Description of Artificial Sequence: Synthetic oligonucleotide"
agaatccatgtgtcttcatt

SEQ ID NO: 2109 - DNA, 20 bp, Artificial Sequence
  source: /note="Description of Artificial Sequence: Synthetic oligonucleotide"
catcacttataaccccacag

SEQ ID NO: 2110 - DNA, 20 bp, Artificial Sequence
  source: /note="Description of Artificial Sequence: Synthetic oligonucleotide"
tggagccctttctcttaaaa

SEQ ID NO: 2111 - DNA, 20 bp, Artificial Sequence
  source: /note="Description of Artificial Sequence: Synthetic oligonucleotide"
gtgggactgattggagacaa

SEQ ID NO: 2112 - DNA, 20 bp, Artificial Sequence
  source: /note="Description of Artificial Sequence: Synthetic oligonucleotide"
tgattctctgagatacttcc

SEQ ID NO: 2113 - DNA, 20 bp, Artificial Sequence
  source: /note="Description of Artificial Sequence: Synthetic oligonucleotide"
tgatctctggaggaagagtg

SEQ ID NO: 2114 - DNA, 20 bp, Artificial Sequence
  source: /note="Description of Artificial Sequence: Synthetic oligonucleotide"
gctatccatcacttataacc

SEQ ID NO: 2115 - DNA, 20 bp, Artificial Sequence
  source: /note="Description of Artificial Sequence: Synthetic oligonucleotide"
catttctgtgaaattgccca

SEQ ID NO: 2116 - DNA, 20 bp, Artificial Sequence
  source: /note="Description of Artificial Sequence: Synthetic oligonucleotide"
aaatcatcccctggagatac

SEQ ID NO: 2117 - DNA, 20 bp, Artificial Sequence
  source: /note="Description of Artificial Sequence: Synthetic oligonucleotide"
cagtaaatcctgtgtcactt

SEQ ID NO: 2118 - DNA, 20 bp, Artificial Sequence
  source: /note="Description of Artificial Sequence: Synthetic oligonucleotide"
agccctttctcttaaaagtt

SEQ ID NO: 2119 - DNA, 20 bp, Artificial Sequence
  source: /note="Description of Artificial Sequence: Synthetic oligonucleotide"
cagagggcaagaggagcaaa

SEQ ID NO: 2120 - DNA, 20 bp, Artificial Sequence
  source: /note="Description of Artificial Sequence: Synthetic oligonucleotide"
tgtgttaaagggaaggccag

SEQ ID NO: 2121 - DNA, 20 bp, Artificial Sequence
  source: /note="Description of Artificial Sequence: Synthetic oligonucleotide"
gaacccatgctcataatgga

SEQ ID NO: 2122 - DNA, 20 bp, Artificial Sequence
  source: /note="Description of Artificial Sequence: Synthetic oligonucleotide"
ttctgtcagatcacatgtac

SEQ ID NO: 2123 - DNA, 20 bp, Artificial Sequence
  source: /note="Description of Artificial Sequence: Synthetic oligonucleotide"
tagtcaagagagaccaaggc

SEQ ID NO: 2124 - DNA, 20 bp, Artificial Sequence
  source: /note="Description of Artificial Sequence: Synthetic oligonucleotide"
acaatgggcagaggatcatg

SEQ ID NO: 2125 - DNA, 20 bp, Artificial Sequence
  source: /note="Description of Artificial Sequence: Synthetic oligonucleotide"
acaggatgctggaaaaggct

SEQ ID NO: 2126 - DNA, 20 bp, Artificial Sequence
  source: /note="Description of Artificial Sequence: Synthetic oligonucleotide"
ctatccatcacttataaccc

SEQ ID NO: 2127 - DNA, 20 bp, Artificial Sequence
  source: /note="Description of Artificial Sequence: Synthetic oligonucleotide"
aactatggcagcagaactgt

SEQ ID NO: 2128 - DNA, 20 bp, Artificial Sequence
  source: /note="Description of Artificial Sequence: Synthetic oligonucleotide"
gaaacaaaccttctggtgcc

SEQ ID NO: 2129 - DNA, 20 bp, Artificial Sequence
  source: /note="Description of Artificial Sequence: Synthetic oligonucleotide"
catcagccattccttaacaa

SEQ ID NO: 2130 - DNA, 20 bp, Artificial Sequence
  source: /note="Description of Artificial Sequence: Synthetic oligonucleotide"
gtgaaattgcccacaatggg

SEQ ID NO: 2131 - DNA, 20 bp, Artificial Sequence
  source: /note="Description of Artificial Sequence: Synthetic oligonucleotide"
agtcagcagagcacaattat

SEQ ID NO: 2132 - DNA, 20 bp, Artificial Sequence
  source: /note="Description of Artificial Sequence: Synthetic oligonucleotide"
gaggaaggatcaggctaaca

SEQ ID NO: 2133 - DNA, 20 bp, Artificial Sequence
  source: /note="Description of Artificial Sequence: Synthetic oligonucleotide"
tagatggaactatggcagca

SEQ ID NO: 2134 - DNA, 20 bp, Artificial Sequence
  source: /note="Description of Artificial Sequence: Synthetic oligonucleotide"
caaccagaaatggcagcttc

SEQ ID NO: 2135 - DNA, 20 bp, Artificial Sequence
  source: /note="Description of Artificial Sequence: Synthetic oligonucleotide"
atttctgtgaaattgcccac

SEQ ID NO: 2136 - DNA, 20 bp, Artificial Sequence
  source: /note="Description of Artificial Sequence: Synthetic oligonucleotide"
ctgactttttcctgtatgat

SEQ ID NO: 2137 - DNA, 20 bp, Artificial Sequence
  source: /note="Description of Artificial Sequence: Synthetic oligonucleotide"
ggttgttgcacattttgtaa

SEQ ID NO: 2138 - DNA, 20 bp, Artificial Sequence
  source: /note="Description of Artificial Sequence: Synthetic oligonucleotide"
aaacctctctgaatactgcc

SEQ ID NO: 2139 - DNA, 20 bp, Artificial Sequence
  source: /note="Description of Artificial Sequence: Synthetic oligonucleotide"
gacaacagtggagggtatac

SEQ ID NO: 2140 - DNA, 20 bp, Artificial Sequence
  source: /note="Description of Artificial Sequence: Synthetic oligonucleotide"
tcagcagagcacaattatgt

SEQ ID NO: 2141 - DNA, 20 bp, Artificial Sequence
  source: /note="Description of Artificial Sequence: Synthetic oligonucleotide"
gtcagcagagcacaattatg

SEQ ID NO: 2142 - DNA, 20 bp, Artificial Sequence
  source: /note="Description of Artificial Sequence: Synthetic oligonucleotide"
tttgtaaactgtgggttctc

SEQ ID NO: 2143 - DNA, 20 bp, Artificial Sequence
  source: /note="Description of Artificial Sequence: Synthetic oligonucleotide"
ctatcagcaggagaagggaa

SEQ ID NO: 2144 - DNA, 20 bp, Artificial Sequence
  source: /note="Description of Artificial Sequence: Synthetic oligonucleotide"
gtcagatcacatgtactttt

SEQ ID NO: 2145 - DNA, 20 bp, Artificial Sequence
  source: /note="Description of Artificial Sequence: Synthetic oligonucleotide"
cacaggatgctggaaaaggc

SEQ ID NO: 2146 - DNA, 20 bp, Artificial Sequence
  source: /note="Description of Artificial Sequence: Synthetic oligonucleotide"
ccagtctggaaacattcatc

SEQ ID NO: 2147 - DNA, 20 bp, Artificial Sequence
  source: /note="Description of Artificial Sequence: Synthetic oligonucleotide"
ctctgtctaggatctagaat

SEQ ID NO: 2148 - DNA, 20 bp, Artificial Sequence
  source: /note="Description of Artificial Sequence: Synthetic oligonucleotide"
gtgaacaccaagcaactgga

SEQ ID NO: 2149 - DNA, 20 bp, Artificial Sequence
  source: /note="Description of Artificial Sequence: Synthetic oligonucleotide"
acttttgacctttaatgtcc

SEQ ID NO: 2150 - DNA, 20 bp, Artificial Sequence
  source: /note="Description of Artificial Sequence: Synthetic oligonucleotide"
aacccatgctcataatggag

SEQ ID NO: 2151 - DNA, 20 bp, Artificial Sequence
  source: /note="Description of Artificial Sequence: Synthetic oligonucleotide"
gtagtcaagagagaccaagg

SEQ ID NO: 2152 - DNA, 20 bp, Artificial Sequence
  source: /note="Description of Artificial Sequence: Synthetic oligonucleotide"
ggtagtcaagagagaccaag

SEQ ID NO: 2153 - DNA, 20 bp, Artificial Sequence
  source: /note="Description of Artificial Sequence: Synthetic oligonucleotide"
aggtagtcaagagagaccaa

SEQ ID NO: 2154 - DNA, 20 bp, Artificial Sequence
  source: /note="Description of Artificial Sequence: Synthetic oligonucleotide"
gaacaccaagcaactggagg

SEQ ID NO: 2155 - DNA, 20 bp, Artificial Sequence
  source: /note="Description of Artificial Sequence: Synthetic oligonucleotide"
cctcagagagacagaagatc

SEQ ID NO: 2156 - DNA, 20 bp, Artificial Sequence
  source: /note="Description of Artificial Sequence: Synthetic oligonucleotide"
tggaactatggcagcagaac

SEQ ID NO: 2157 - DNA, 20 bp, Artificial Sequence
  source: /note="Description of Artificial Sequence: Synthetic oligonucleotide"
tgaacccatgctcataatgg

SEQ ID NO: 2158 - DNA, 20 bp, Artificial Sequence
  source: /note="Description of Artificial Sequence: Synthetic oligonucleotide"
aaggatcaggctaacattgc

SEQ ID NO: 2159 - DNA, 20 bp, Artificial Sequence
  source: /note="Description of Artificial Sequence: Synthetic oligonucleotide"
gcaggaaacctctctgaata

SEQ ID NO: 2160 - DNA, 20 bp, Artificial Sequence
  source: /note="Description of Artificial Sequence: Synthetic oligonucleotide"
atcagccattccttaacaat

SEQ ID NO: 2161 - DNA, 20 bp, Artificial Sequence
  source: /note="Description of Artificial Sequence: Synthetic oligonucleotide"
gatgatgacagagactctgg

SEQ ID NO: 2162 - DNA, 20 bp, Artificial Sequence
  source: /note="Description of Artificial Sequence: Synthetic oligonucleotide"
ggaaggatcaggctaacatt

SEQ ID NO: 2163 - DNA, 20 bp, Artificial Sequence
  source: /note="Description of Artificial Sequence: Synthetic oligonucleotide"
tcagccattccttaacaatg

SEQ ID NO: 2164 - DNA, 20 bp, Artificial Sequence
  source: /note="Description of Artificial Sequence: Synthetic oligonucleotide"
atgccccaaattgttgaatc

SEQ ID NO: 2165 - DNA, 20 bp, Artificial Sequence
  source: /note="Description of Artificial Sequence: Synthetic oligonucleotide"
tctgtctaggatctagaatc

SEQ ID NO: 2166 - DNA, 20 bp, Artificial Sequence
  source: /note="Description of Artificial Sequence: Synthetic oligonucleotide"
cagccattccttaacaatga

SEQ ID NO: 2167 - DNA, 20 bp, Artificial Sequence
  source: /note="Description of Artificial Sequence: Synthetic oligonucleotide"
ttctgtgaaattgcccacaa

SEQ ID NO: 2168 - DNA, 20 bp, Artificial Sequence
  source: /note="Description of Artificial Sequence: Synthetic oligonucleotide"
attctacaatgagatgcctc

SEQ ID NO: 2169 - DNA, 20 bp, Artificial Sequence
  source: /note="Description of Artificial Sequence: Synthetic oligonucleotide"
atagatggaactatggcagc

SEQ ID NO: 2170 - DNA, 20 bp, Artificial Sequence
  source: /note="Description of Artificial Sequence: Synthetic oligonucleotide"
aggaaggatcaggctaacat

SEQ ID NO: 2171 - DNA, 20 bp, Artificial Sequence
  source: /note="Description of Artificial Sequence: Synthetic oligonucleotide"
gaggagcaaagtgaacacca

SEQ ID NO: 2172 - DNA, 20 bp, Artificial Sequence
  source: /note="Description of Artificial Sequence: Synthetic oligonucleotide"
aagcaactcttgtctaaggg

SEQ ID NO: 2173 - DNA, 20 bp, Artificial Sequence
  source: /note="Description of Artificial Sequence: Synthetic oligonucleotide"
tagctgattctctgagatac

SEQ ID NO: 2174 - DNA, 20 bp, Artificial Sequence
  source: /note="Description of Artificial Sequence: Synthetic oligonucleotide"
ctgtctaggatctagaatca

SEQ ID NO: 2175 - DNA, 20 bp, Artificial Sequence
  source: /note="Description of Artificial Sequence: Synthetic oligonucleotide"
ttttgtaaactgtgggttct

SEQ ID NO: 2176 - DNA, 20 bp, Artificial Sequence
  source: /note="Description of Artificial Sequence: Synthetic oligonucleotide"
cattctacaatgagatgcct

SEQ ID NO: 2177 - DNA, 20 bp, Artificial Sequence
  source: /note="Description of Artificial Sequence: Synthetic oligonucleotide"
ctgattctctgagatacttc

SEQ ID NO: 2178 - DNA, 20 bp, Artificial Sequence
  source: /note="Description of Artificial Sequence: Synthetic oligonucleotide"
ggaaacttagctgattctct

SEQ ID NO: 2179 - DNA, 20 bp, Artificial Sequence
  source: /note="Description of Artificial Sequence: Synthetic oligonucleotide"
atggaactatggcagcagaa

SEQ ID NO: 2180 - DNA, 20 bp, Artificial Sequence
  source: /note="Description of Artificial Sequence: Synthetic oligonucleotide"
ccccacatgaaatccaaact

SEQ ID NO: 2181 - DNA, 20 bp, Artificial Sequence
  source: /note="Description of Artificial Sequence: Synthetic oligonucleotide"
gaactatggcagcagaactg

SEQ ID NO: 2182 - DNA, 20 bp, Artificial Sequence
  source: /note="Description of Artificial Sequence: Synthetic oligonucleotide"
ctgaacccatgctcataatg

SEQ ID NO: 2183 - DNA, 20 bp, Artificial Sequence
  source: /note="Description of Artificial Sequence: Synthetic oligonucleotide"
tctgtgaaattgcccacaat

SEQ ID NO: 2184 - DNA, 20 bp, Artificial Sequence
  source: /note="Description of Artificial Sequence: Synthetic oligonucleotide"
ttagctgattctctgagata

SEQ ID NO: 2185 - DNA, 20 bp, Artificial Sequence
  source: /note="Description of Artificial Sequence: Synthetic oligonucleotide"
gatgctggaaaaggctgatc

SEQ ID NO: 2186 - DNA, 20 bp, Artificial Sequence
  source: /note="Description of Artificial Sequence: Synthetic oligonucleotide"
agtgaacaccaagcaactgg

SEQ ID NO: 2187 - DNA, 20 bp, Artificial Sequence
  source: /note="Description of Artificial Sequence: Synthetic oligonucleotide"
atcagcaggagaagggaatg

SEQ ID NO: 2188 - DNA, 20 bp, Artificial Sequence
  source: /note="Description of Artificial Sequence: Synthetic oligonucleotide"
aacttagctgattctctgag

SEQ ID NO: 2189 - DNA, 20 bp, Artificial Sequence
  source: /note="Description of Artificial Sequence: Synthetic oligonucleotide"
tccccacatgaaatccaaac

SEQ ID NO: 2190 - DNA, 20 bp, Artificial Sequence
  source: /note="Description of Artificial Sequence: Synthetic oligonucleotide"
gccactctgaactttatgaa

SEQ ID NO: 2191 - DNA, 20 bp, Artificial Sequence
  source: /note="Description of Artificial Sequence: Synthetic oligonucleotide"
ggacttttgacctttaatgt

SEQ ID NO: 2192 - DNA, 20 bp, Artificial Sequence
  source: /note="Description of Artificial Sequence: Synthetic oligonucleotide"
aaagagccagaaatcatccc

SEQ ID NO: 2193 - DNA, 20 bp, Artificial Sequence
  source: /note="Description of Artificial Sequence: Synthetic oligonucleotide"
cctttctcttaaaagtttcc

SEQ ID NO: 2194 - DNA, 20 bp, Artificial Sequence
  source: /note="Description of Artificial Sequence: Synthetic oligonucleotide"
ccctttctcttaaaagtttc

SEQ ID NO: 2195 - DNA, 20 bp, Artificial Sequence
  source: /note="Description of Artificial Sequence: Synthetic oligonucleotide"
ttccccacatgaaatccaaa

SEQ ID NO: 2196 - DNA, 20 bp, Artificial Sequence
  source: /note="Description of Artificial Sequence: Synthetic oligonucleotide"
taatctcaacttctgttggg

SEQ ID NO: 2197 - DNA, 20 bp, Artificial Sequence
  source: /note="Description of Artificial Sequence: Synthetic oligonucleotide"
attggagacaaagagccaga

SEQ ID NO: 2198 - DNA, 20 bp, Artificial Sequence
  source: /note="Description of Artificial Sequence: Synthetic oligonucleotide"
tatcagcaggagaagggaat

SEQ ID NO: 2199 - DNA, 20 bp, Artificial Sequence
  source: /note="Description of Artificial Sequence: Synthetic oligonucleotide"
gtcagctttttgttgcaaaa

SEQ ID NO: 2200 - DNA, 20 bp, Artificial Sequence
  source: /note="Description of Artificial Sequence: Synthetic oligonucleotide"
acaatgaatgtggtacctgg

SEQ ID NO: 2201 - DNA, 20 bp, Artificial Sequence
  source: /note="Description of Artificial Sequence: Synthetic oligonucleotide"
agaggagcaaagtgaacacc

SEQ ID NO: 2202 - DNA, 20 bp, Artificial Sequence
  source: /note="Description of Artificial Sequence: Synthetic oligonucleotide"
tcacatttggatggacaagt

SEQ ID NO: 2203 - DNA, 20 bp, Artificial Sequence
  source: /note="Description of Artificial Sequence: Synthetic oligonucleotide"
tgatcacatttggatggaca

SEQ ID NO: 2204 - DNA, 20 bp, Artificial Sequence
  source: /note="Description of Artificial Sequence: Synthetic oligonucleotide"
ggatctgatgatgacagaga

SEQ ID NO: 2205 - DNA, 20 bp, Artificial Sequence
  source: /note="Description of Artificial Sequence: Synthetic oligonucleotide"
gaggatctgatgatgacaga

SEQ ID NO: 2206 - DNA, 20 bp, Artificial Sequence
  source: /note="Description of Artificial Sequence: Synthetic oligonucleotide"
cagtctggaaacattcatct

SEQ ID NO: 2207 - DNA, 20 bp, Artificial Sequence
  source: /note="Description of Artificial Sequence: Synthetic oligonucleotide"
ggatctagaatcataaccca

SEQ ID NO: 2208 - DNA, 20 bp, Artificial Sequence
  source: /note="Description of Artificial Sequence: Synthetic oligonucleotide"
gaaatccaaactctctctct

SEQ ID NO: 2209 - DNA, 20 bp, Artificial Sequence
  source: /note="Description of Artificial Sequence: Synthetic oligonucleotide"
gaaacctctctgaatactgc

SEQ ID NO: 2210 - DNA, 20 bp, Artificial Sequence
  source: /note="Description of Artificial Sequence: Synthetic oligonucleotide"
ctgaagagtgccaatcatta

SEQ ID NO: 2211 - DNA, 20 bp, Artificial Sequence
  source: /note="Description of Artificial Sequence: Synthetic oligonucleotide"
caagcaactcttgtctaagg

SEQ ID NO: 2212 - DNA, 20 bp, Artificial Sequence
  source: /note="Description of Artificial Sequence: Synthetic oligonucleotide"
aaaagccatttccatcaagc

SEQ ID NO: 2213 - DNA, 20 bp, Artificial Sequence
  source: /note="Description of Artificial Sequence: Synthetic oligonucleotide"
gactttttcctgtatgatat

SEQ ID NO: 2214 - DNA, 20 bp, Artificial Sequence
  source: /note="Description of Artificial Sequence: Synthetic oligonucleotide"
ttctcctggtatatctataa

SEQ ID NO: 2215 - DNA, 20 bp, Artificial Sequence
  source: /note="Description of Artificial Sequence: Synthetic oligonucleotide"
agctttttgttgcaaaatcc

SEQ ID NO: 2216 - DNA, 20 bp, Artificial Sequence
  source: /note="Description of Artificial Sequence: Synthetic oligonucleotide"
gaagagtgccaatcattaca

SEQ ID NO: 2217 - DNA, 20 bp, Artificial Sequence
  source: /note="Description of Artificial Sequence: Synthetic oligonucleotide"
tgactttttcctgtatgata

SEQ ID NO: 2218 - DNA, 20 bp, Artificial Sequence
  source: /note="Description of Artificial Sequence: Synthetic oligonucleotide"
gctttcatcagacaatatca

SEQ ID NO: 2219 - DNA, 20 bp, Artificial Sequence
  source: /note="Description of Artificial Sequence: Synthetic oligonucleotide"
acattctacaatgagatgcc

SEQ ID NO: 2220 - DNA, 20 bp, Artificial Sequence
  source: /note="Description of Artificial Sequence: Synthetic oligonucleotide"
tttggatggacaagttagga

SEQ ID NO: 2221 - DNA, 20 bp, Artificial Sequence
  source: /note="Description of Artificial Sequence: Synthetic oligonucleotide"
ttctcttaaaagtttcctct

SEQ ID NO: 2222 - DNA, 20 bp, Artificial Sequence
  source: /note="Description of Artificial Sequence: Synthetic oligonucleotide"
gagcaaagtgaacaccaagc

SEQ ID NO: 2223 - DNA, 20 bp, Artificial Sequence
  source: /note="Description of Artificial Sequence: Synthetic oligonucleotide"
agcaaagtgaacaccaagca

SEQ ID NO: 2224 - DNA, 20 bp, Artificial Sequence
  source: /note="Description of Artificial Sequence: Synthetic oligonucleotide"
caatgccccaaattgttgaa

SEQ ID NO: 2225 - DNA, 20 bp, Artificial Sequence
  source: /note="Description of Artificial Sequence: Synthetic oligonucleotide"
tggagaagtaagtggccaaa

SEQ ID NO: 2226 - DNA, 20 bp, Artificial Sequence
  source: /note="Description of Artificial Sequence: Synthetic oligonucleotide"
attacaaatcagcttcagca

SEQ ID NO: 2227 - DNA, 20 bp, Artificial Sequence
  source: /note="Description of Artificial Sequence: Synthetic oligonucleotide"
cattacaaatcagcttcagc

SEQ ID NO: 2228 - DNA, 20 bp, Artificial Sequence
  source: /note="Description of Artificial Sequence: Synthetic oligonucleotide"
gtctggaaacattcatcttt

SEQ ID NO: 2229 - DNA, 20 bp, Artificial Sequence
  source: /note="Description of Artificial Sequence: Synthetic oligonucleotide"
gacttttgacctttaatgtc

SEQ ID NO: 2230 - DNA, 20 bp, Artificial Sequence
  source: /note="Description of Artificial Sequence: Synthetic oligonucleotide"
aggaaacttagctgattctc

SEQ ID NO: 2231 - DNA, 20 bp, Artificial Sequence
  source: /note="Description of Artificial Sequence: Synthetic oligonucleotide"
acattttgtaaactgtgggt

SEQ ID NO: 2232 - DNA, 20 bp, Artificial Sequence
  source: /note="Description of Artificial Sequence: Synthetic oligonucleotide"
cacatttggatggacaagtt

SEQ ID NO: 2233 - DNA, 20 bp, Artificial Sequence
  source: /note="Description of Artificial Sequence: Synthetic oligonucleotide"
attttgtaaactgtgggttc

SEQ ID NO: 2234 - DNA, 20 bp, Artificial Sequence
  source: /note="Description of Artificial Sequence: Synthetic oligonucleotide"
aggatctagaatcataaccc

SEQ ID NO: 2235 - DNA, 20 bp, Artificial Sequence
  source: /note="Description of Artificial Sequence: Synthetic oligonucleotide"
cccagagatgtcaagagaaa

SEQ ID NO: 2236 - DNA, 20 bp, Artificial Sequence
  source: /note="Description of Artificial Sequence: Synthetic oligonucleotide"
aggatctgatgatgacagag

SEQ ID NO: 2237 - DNA, 20 bp, Artificial Sequence
  source: /note="Description of Artificial Sequence: Synthetic oligonucleotide"
cattttgtaaactgtgggtt

SEQ ID NO: 2238 - DNA, 20 bp, Artificial Sequence
  source: /note="Description of Artificial Sequence: Synthetic oligonucleotide"
gcacattttgtaaactgtgg

SEQ ID NO: 2239 - DNA, 20 bp, Artificial Sequence
  source: /note="Description of Artificial Sequence: Synthetic oligonucleotide"
gacaagcaactcttgtctaa

SEQ ID NO: 2240 - DNA, 20 bp, Artificial Sequence
  source: /note="Description of Artificial Sequence: Synthetic oligonucleotide"
actttttcctgtatgatatt

SEQ ID NO: 2241 - DNA, 20 bp, Artificial Sequence
  source: /note="Description of Artificial Sequence: Synthetic oligonucleotide"
gccaatcattacaaatcagc

SEQ ID NO: 2242 - DNA, 20 bp, Artificial Sequence
  source: /note="Description of Artificial Sequence: Synthetic oligonucleotide"
gaaggatcaggctaacattg

SEQ ID NO: 2243 - DNA, 20 bp, Artificial Sequence
  source: /note="Description of Artificial Sequence: Synthetic oligonucleotide"
tgaggatctgatgatgacag

SEQ ID NO: 2244 - DNA, 20 bp, Artificial Sequence
  source: /note="Description of Artificial Sequence: Synthetic oligonucleotide"
tgatgatgacagagactctg

SEQ ID NO: 2245 - DNA, 20 bp, Artificial Sequence
  source: /note="Description of Artificial Sequence: Synthetic oligonucleotide"
aggaaacctctctgaatact

SEQ ID NO: 2246 - DNA, 20 bp, Artificial Sequence
  source: /note="Description of Artificial Sequence: Synthetic oligonucleotide"
ttcctcatacattctacaat

SEQ ID NO: 2247 - DNA, 20 bp, Artificial Sequence
  source: /note="Description of Artificial Sequence: Synthetic oligonucleotide"
agctttcatcagacaatatc

SEQ ID NO: 2248 - DNA, 20 bp, Artificial Sequence
  source: /note="Description of Artificial Sequence: Synthetic oligonucleotide"
atgaggatctgatgatgaca

SEQ ID NO: 2249 - DNA, 20 bp, Artificial Sequence
  source: /note="Description of Artificial Sequence: Synthetic oligonucleotide"
tgaagagtgccaatcattac

SEQ ID NO: 2250 - DNA, 20 bp, Artificial Sequence
  source: /note="Description of Artificial Sequence: Synthetic oligonucleotide"
ctttctcttaaaagtttcct

SEQ ID NO: 2251 - DNA, 20 bp, Artificial Sequence
  source: /note="Description of Artificial Sequence: Synthetic oligonucleotide"
ggaaacctctctgaatactg

SEQ ID NO: 2252 - DNA, 20 bp, Artificial Sequence
  source: /note="Description of Artificial Sequence: Synthetic oligonucleotide"
tcttcattcattcacctaaa

SEQ ID NO: 2253 - DNA, 20 bp, Artificial Sequence
  source: /note="Description of Artificial Sequence: Synthetic oligonucleotide"
aaacttagctgattctctga

SEQ ID NO: 2254 - DNA, 20 bp, Artificial Sequence
  source: /note="Description of Artificial Sequence: Synthetic oligonucleotide"
gaaacttagctgattctctg

SEQ ID NO: 2255 - DNA, 20 bp, Artificial Sequence
  source: /note="Description of Artificial Sequence: Synthetic oligonucleotide"
gatcacatttggatggacaa

SEQ ID NO: 2256 - DNA, 20 bp, Artificial Sequence
  source: /note="Description of Artificial Sequence: Synthetic oligonucleotide"
aatgccccaaattgttgaat

SEQ ID NO: 2257 - DNA, 20 bp, Artificial Sequence
  source: /note="Description of Artificial Sequence: Synthetic oligonucleotide"
atttggatggacaagttagg

SEQ ID NO: 2258 - DNA, 20 bp, Artificial Sequence
  source: /note="Description of Artificial Sequence: Synthetic oligonucleotide"
tcctcatacattctacaatg

SEQ ID NO: 2259 - DNA, 20 bp, Artificial Sequence
  source: /note="Description of Artificial Sequence: Synthetic oligonucleotide"
agccattccttaacaatgaa

SEQ ID NO: 2260 - DNA, 20 bp, Artificial Sequence
  source: /note="Description of Artificial Sequence: Synthetic oligonucleotide"
cctcatacattctacaatga

SEQ ID NO: 2261 - DNA, 20 bp, Artificial Sequence
  source: /note="Description of Artificial Sequence: Synthetic oligonucleotide"
aactgtgttaaagggaaggc

SEQ ID NO: 2262 - DNA, 20 bp, Artificial Sequence
  source: /note="Description of Artificial Sequence: Synthetic oligonucleotide"
gatctagaatcataacccac

SEQ ID NO: 2263 - DNA, 20 bp, Artificial Sequence
  source: /note="Description of Artificial Sequence: Synthetic oligonucleotide"
aggagcaaagtgaacaccaa

SEQ ID NO: 2264 - DNA, 20 bp, Artificial Sequence
  source: /note="Description of Artificial Sequence: Synthetic oligonucleotide"
gatctgatgatgacagagac

SEQ ID NO: 2265 - DNA, 20 bp, Artificial Sequence
  source: /note="Description of Artificial Sequence: Synthetic oligonucleotide"
gccattccttaacaatgaat

SEQ ID NO: 2266 - DNA, 20 bp, Artificial Sequence
  source: /note="Description of Artificial Sequence: Synthetic oligonucleotide"
caaagagccagaaatcatcc

SEQ ID NO: 2267 - DNA, 20 bp, Artificial Sequence
  source: /note="Description of Artificial Sequence: Synthetic oligonucleotide"
caggaaacctctctgaatac

SEQ ID NO: 2268 - DNA, 20 bp, Artificial Sequence
  source: /note="Description of Artificial Sequence: Synthetic oligonucleotide"
ttaatctcaacttctgttgg

SEQ ID NO: 2269 - DNA, 20 bp, Artificial Sequence
  source: /note="Description of Artificial Sequence: Synthetic oligonucleotide"
tttctcttaaaagtttcctc

SEQ ID NO: 2270 - DNA, 20 bp, Artificial Sequence
  source: /note="Description of Artificial Sequence: Synthetic oligonucleotide"
acaagcaactcttgtctaag

SEQ ID NO: 2271 - DNA, 20 bp, Artificial Sequence
  source: /note="Description of Artificial Sequence: Synthetic oligonucleotide"
ataaagaacagcttctccag

SEQ ID NO: 2272 - DNA, 20 bp, Artificial Sequence
  source: /note="Description of Artificial Sequence: Synthetic oligonucleotide"
gggaaaggatgaatgagtgt

SEQ ID NO: 2273 - DNA, 20 bp, Artificial Sequence
  source: /note="Description of Artificial Sequence: Synthetic oligonucleotide"
ctataaagaacagcttctcc

SEQ ID NO: 2274 - DNA, 20 bp, Artificial Sequence
  source: /note="Description of Artificial Sequence: Synthetic oligonucleotide"
actgaaacaaaccttctggt

SEQ ID NO: 2275 - DNA, 20 bp, Artificial Sequence
  source: /note="Description of Artificial Sequence: Synthetic oligonucleotide"
ctttttcctgtatgatatta

SEQ ID NO: 2276 - DNA, 20 bp, Artificial Sequence
  source: /note="Description of Artificial Sequence: Synthetic oligonucleotide"
cttcattcattcacctaaac

SEQ ID NO: 2277 - DNA, 20 bp, Artificial Sequence
  source: /note="Description of Artificial Sequence: Synthetic oligonucleotide"
ggagaagtaagtggccaaaa

SEQ ID NO: 2278 - DNA, 20 bp, Artificial Sequence
  source: /note="Description of Artificial Sequence: Synthetic oligonucleotide"
gttgttgcacattttgtaaa

SEQ ID NO: 2279 - DNA, 20 bp, Artificial Sequence
  source: /note="Description of Artificial Sequence: Synthetic oligonucleotide"
gtgccaatcattacaaatca

SEQ ID NO: 2280 - DNA, 20 bp, Artificial Sequence
  source: /note="Description of Artificial Sequence: Synthetic oligonucleotide"
gcaaagtgaacaccaagcaa

SEQ ID NO: 2281 - DNA, 20 bp, Artificial Sequence
  source: /note="Description of Artificial Sequence: Synthetic oligonucleotide"
cacattttgtaaactgtggg

SEQ ID NO: 2282 - DNA, 20 bp, Artificial Sequence
  source: /note="Description of Artificial Sequence: Synthetic oligonucleotide"
actgattggagacaaagagc

SEQ ID NO: 2283 - DNA, 20 bp, Artificial Sequence
  source: /note="Description of Artificial Sequence: Synthetic oligonucleotide"
tggacttttgacctttaatg

SEQ ID NO: 2284 - DNA, 20 bp, Artificial Sequence
  source: /note="Description of Artificial Sequence: Synthetic oligonucleotide"
tctcctggtatatctataaa

SEQ ID NO: 2285 - DNA, 20 bp, Artificial Sequence
  source: /note="Description of Artificial Sequence: Synthetic oligonucleotide"
ttacaaatcagcttcagcaa

SEQ ID NO: 2286 - DNA, 20 bp, Artificial Sequence
  source: /note="Description of Artificial Sequence: Synthetic oligonucleotide"
gttaggaaacttagctgatt

SEQ ID NO: 2287 - DNA, 20 bp, Artificial Sequence
  source: /note="Description of Artificial Sequence: Synthetic oligonucleotide"
acatttggatggacaagtta

SEQ ID NO: 2288 - DNA, 20 bp, Artificial Sequence
  source: /note="Description of Artificial Sequence: Synthetic oligonucleotide"
ttggatggacaagttaggaa

SEQ ID NO: 2289 - DNA, 20 bp, Artificial Sequence
  source: /note="Description of Artificial Sequence: Synthetic oligonucleotide"
taggaaacttagctgattct

SEQ ID NO: 2290 - DNA, 20 bp, Artificial Sequence
  source: /note="Description of Artificial Sequence: Synthetic oligonucleotide"
cagctttttgttgcaaaatc

SEQ ID NO: 2291 - DNA, 20 bp, Artificial Sequence
  source: /note="Description of Artificial Sequence: Synthetic oligonucleotide"
tcagctttttgttgcaaaat

SEQ ID NO: 2292 - DNA, 20 bp, Artificial Sequence
  source: /note="Description of Artificial Sequence: Synthetic oligonucleotide"
agttaggaaacttagctgat

SEQ ID NO: 2293 - DNA, 20 bp, Artificial Sequence
  source: /note="Description of Artificial Sequence: Synthetic oligonucleotide"
ccacatgaaatccaaactct

SEQ ID NO: 2294 - DNA, 20 bp, Artificial Sequence
  source: /note="Description of Artificial Sequence: Synthetic oligonucleotide"
ctgaaacaaaccttctggtg

SEQ ID NO: 2295 - DNA, 20 bp, Artificial Sequence
  source: /note="Description of Artificial Sequence: Synthetic oligonucleotide"
tataaagaacagcttctcca

SEQ ID NO: 2296 - DNA, 20 bp, Artificial Sequence
  source: /note="Description of Artificial Sequence: Synthetic oligonucleotide"
tccttaacaatgaatgtggt

SEQ ID NO: 2297 - DNA, 20 bp, Artificial Sequence
  source: /note="Description of Artificial Sequence: Synthetic oligonucleotide"
catttggatggacaagttag

SEQ ID NO: 2298 - DNA, 20 bp, Artificial Sequence
  source: /note="Description of Artificial Sequence: Synthetic oligonucleotide"
gagatgattccaaagaggat

SEQ ID NO: 2299 - DNA, 20 bp, Artificial Sequence
  source: /note="Description of Artificial Sequence: Synthetic oligonucleotide"
ccaatcattacaaatcagct

SEQ ID NO: 2300 - DNA, 20 bp, Artificial Sequence
  source: /note="Description of Artificial Sequence: Synthetic oligonucleotide"
ttatagatggaactatggca

SEQ ID NO: 2301 - DNA, 20 bp, Artificial Sequence
  source: /note="Description of Artificial Sequence: Synthetic oligonucleotide"
ttgcacattttgtaaactgt

SEQ ID NO: 2302 - DNA, 20 bp, Artificial Sequence
  source: /note="Description of Artificial Sequence: Synthetic oligonucleotide"
gttgcacattttgtaaactg

SEQ ID NO: 2303 - DNA, 20 bp, Artificial Sequence
  source: /note="Description of Artificial Sequence: Synthetic oligonucleotide"
tgttgcacattttgtaaact

SEQ ID NO: 2304 - DNA, 20 bp, Artificial Sequence
  source: /note="Description of Artificial Sequence: Synthetic oligonucleotide"
agagtgccaatcattacaaa

SEQ ID NO: 2305 - DNA, 20 bp, Artificial Sequence
  source: /note="Description of Artificial Sequence: Synthetic oligonucleotide"
aagagtgccaatcattacaa

SEQ ID NO: 2306 - DNA, 20 bp, Artificial Sequence
  source: /note="Description of Artificial Sequence: Synthetic oligonucleotide"
aagtgaacaccaagcaactg

SEQ ID NO: 2307 - DNA, 20 bp, Artificial Sequence
  source: /note="Description of Artificial Sequence: Synthetic oligonucleotide"
caagctttcatcagacaata

SEQ ID NO: 2308 - DNA, 20 bp, Artificial Sequence
  source: /note="Description of Artificial Sequence: Synthetic oligonucleotide"
tcattacaaatcagcttcag

SEQ ID NO: 2309 - DNA, 20 bp, Artificial Sequence
  source: /note="Description of Artificial Sequence: Synthetic oligonucleotide"
tatagatggaactatggcag

SEQ ID NO: 2310 - DNA, 20 bp, Artificial Sequence
  source: /note="Description of Artificial Sequence: Synthetic oligonucleotide"
gagtgccaatcattacaaat

SEQ ID NO: 2311 - DNA, 20 bp, Artificial Sequence
  source: /note="Description of Artificial Sequence: Synthetic oligonucleotide"
agtgccaatcattacaaatc

SEQ ID NO: 2312 - DNA, 20 bp, Artificial Sequence
  source: /note="Description of Artificial Sequence: Synthetic oligonucleotide"
catcagacaatatcacatgt

SEQ ID NO: 2313 - DNA, 20 bp, Artificial Sequence
  source: /note="Description of Artificial Sequence: Synthetic oligonucleotide"
atcattacaaatcagcttca

SEQ ID NO: 2314 - DNA, 20 bp, Artificial Sequence
  source: /note="Description of Artificial Sequence: Synthetic oligonucleotide"
tgcacattttgtaaactgtg

SEQ ID NO: 2315 - DNA, 20 bp, Artificial Sequence
  source: /note="Description of Artificial Sequence: Synthetic oligonucleotide"
acatgtacttttaatgtgga

SEQ ID NO: 2316 - DNA, 20 bp, Artificial Sequence
  source: /note="Description of Artificial Sequence: Synthetic oligonucleotide"
cacatgtacttttaatgtgg

SEQ ID NO: 2317 - DNA, 20 bp, Artificial Sequence
  source: /note="Description of Artificial Sequence: Synthetic oligonucleotide"
gaatgaggatctgatgatga

SEQ ID NO: 2318 - DNA, 20 bp, Artificial Sequence
  source: /note="Description of Artificial Sequence: Synthetic oligonucleotide"
ctttcatcagacaatatcac

SEQ ID NO: 2319 - DNA, 20 bp, Artificial Sequence
  source: /note="Description of Artificial Sequence: Synthetic oligonucleotide"
aacaatgaatgtggtacctg

SEQ ID NO: 2320 - DNA, 20 bp, Artificial Sequence
  source: /note="Description of Artificial Sequence: Synthetic oligonucleotide"
acaagttaggaaacttagct

SEQ ID NO: 2321 - DNA, 20 bp, Artificial Sequence
  source: /note="Description of Artificial Sequence: Synthetic oligonucleotide"
ccagagatgtcaagagaaac

SEQ ID NO: 2322 - DNA, 20 bp, Artificial Sequence
  source: /note="Description of Artificial Sequence: Synthetic oligonucleotide"
tttatagatggaactatggc

SEQ ID NO: 2323 - DNA, 20 bp, Artificial Sequence
  source: /note="Description of Artificial Sequence: Synthetic oligonucleotide"
cagacaatatcacatgtact

SEQ ID NO: 2324 - DNA, 20 bp, Artificial Sequence
  source: /note="Description of Artificial Sequence: Synthetic oligonucleotide"
atttaatctcaacttctgtt

SEQ ID NO: 2325 - DNA, 20 bp, Artificial Sequence
  source: /note="Description of Artificial Sequence: Synthetic oligonucleotide"
tttaatctcaacttctgttg

SEQ ID NO: 2326 - DNA, 20 bp, Artificial Sequence
  source: /note="Description of Artificial Sequence: Synthetic oligonucleotide"
ggatggacaagttaggaaac

SEQ ID NO: 2327 - DNA, 20 bp, Artificial Sequence
  source: /note="Description of Artificial Sequence: Synthetic oligonucleotide"
gagaagtaagtggccaaaac

SEQ ID NO: 2328 - DNA, 20 bp, Artificial Sequence
  source: /note="Description of Artificial Sequence: Synthetic oligonucleotide"
ttaggaaacttagctgattc

SEQ ID NO: 2329 - DNA, 20 bp, Artificial Sequence
  source: /note="Description of Artificial Sequence: Synthetic oligonucleotide"
agaagtaagtggccaaaaca

SEQ ID NO: 2330 - DNA, 20 bp, Artificial Sequence
  source: /note="Description of Artificial Sequence: Synthetic oligonucleotide"
tcctggtatatctataaaga

SEQ ID NO: 2331 - DNA, 20 bp, Artificial Sequence
  source: /note="Description of Artificial Sequence: Synthetic oligonucleotide"
gaactgtgttaaagggaagg

SEQ ID NO: 2332 - DNA, 20 bp, Artificial Sequence
  source: /note="Description of Artificial Sequence: Synthetic oligonucleotide"
tccaaagaggataaaccaga

SEQ ID NO: 2333 - DNA, 20 bp, Artificial Sequence
  source: /note="Description of Artificial Sequence: Synthetic oligonucleotide"
tttcatcagacaatatcaca

SEQ ID NO: 2334 - DNA, 20 bp, Artificial Sequence
  source: /note="Description of Artificial Sequence: Synthetic oligonucleotide"
taacaatgaatgtggtacct

SEQ ID NO: 2335 - DNA, 20 bp, Artificial Sequence
  source: /note="Description of Artificial Sequence: Synthetic oligonucleotide"
caagaggagcaaagtgaaca

SEQ ID NO: 2336 - DNA, 20 bp, Artificial Sequence
  source: /note="Description of Artificial Sequence: Synthetic oligonucleotide"
aatgaggatctgatgatgac

SEQ ID NO: 2337 - DNA, 20 bp, Artificial Sequence
  source: /note="Description of Artificial Sequence: Synthetic oligonucleotide"
tacattctacaatgagatgc

SEQ ID NO: 2338 - DNA, 20 bp, Artificial Sequence
  source: /note="Description of Artificial Sequence: Synthetic oligonucleotide"
aagctttcatcagacaatat

SEQ ID NO: 2339 - DNA, 20 bp, Artificial Sequence
  source: /note="Description of Artificial Sequence: Synthetic oligonucleotide"
aagttaggaaacttagctga

SEQ ID NO: 2340 - DNA, 20 bp, Artificial Sequence
  source: /note="Description of Artificial Sequence: Synthetic oligonucleotide"
caagttaggaaacttagctg

SEQ ID NO: 2341 - DNA, 20 bp, Artificial Sequence
  source: /note="Description of Artificial Sequence: Synthetic oligonucleotide"
ccttaacaatgaatgtggta

SEQ ID NO: 2342 - DNA, 20 bp, Artificial Sequence
  source: /note="Description of Artificial Sequence: Synthetic oligonucleotide"
gacaagttaggaaacttagc

SEQ ID NO: 2343 - DNA, 20 bp, Artificial Sequence
  source: /note="Description of Artificial Sequence: Synthetic oligonucleotide"
tggatggacaagttaggaaa

SEQ ID NO: 2344 - DNA, 20 bp, Artificial Sequence
  source: /note="Description of Artificial Sequence: Synthetic oligonucleotide"
ggaaaggatgaatgagtgtg

SEQ ID NO: 2345 - DNA, 20 bp, Artificial Sequence
  source: /note="Description of Artificial Sequence: Synthetic oligonucleotide"
ttcatcagacaatatcacat

SEQ ID NO: 2346 - DNA, 20 bp, Artificial Sequence
  source: /note="Description of Artificial Sequence: Synthetic oligonucleotide"
agatgattccaaagaggata

SEQ ID NO: 2347 - DNA, 20 bp, Artificial Sequence
  source: /note="Description of Artificial Sequence: Synthetic oligonucleotide"
ttgttgcacattttgtaaac

SEQ ID NO: 2348 - DNA, 20 bp, Artificial Sequence
  source: /note="Description of Artificial Sequence: Synthetic oligonucleotide"
tctataaagaacagcttctc

SEQ ID NO: 2349 - DNA, 20 bp, Artificial Sequence
  source: /note="Description of Artificial Sequence: Synthetic oligonucleotide"
tcagacaatatcacatgtac

SEQ ID NO: 2350 - DNA, 20 bp, Artificial Sequence
  source: /note="Description of Artificial Sequence: Synthetic oligonucleotide"
atcacatgtacttttaatgt

SEQ ID NO: 2351 - DNA, 20 bp, Artificial Sequence
  source: /note="Description of Artificial Sequence: Synthetic oligonucleotide"
aaagtgaacaccaagcaact

SEQ ID NO: 2352 - DNA, 20 bp, Artificial Sequence
  source: /note="Description of Artificial Sequence: Synthetic oligonucleotide"
acaaagagccagaaatcatc

SEQ ID NO: 2353 - DNA, 20 bp, Artificial Sequence
  source: /note="Description of Artificial Sequence: Synthetic oligonucleotide"
tgccaatcattacaaatcag

SEQ ID NO: 2354 - DNA, 20 bp, Artificial Sequence
  source: /note="Description of Artificial Sequence: Synthetic oligonucleotide"
tcatcagacaatatcacatg

SEQ ID NO: 2355 - DNA, 20 bp, Artificial Sequence
  source: /note="Description of Artificial Sequence: Synthetic oligonucleotide"
taggatctagaatcataacc

SEQ ID NO: 2356 - DNA, 20 bp, Artificial Sequence
  source: /note="Description of Artificial Sequence: Synthetic oligonucleotide"
aagaggagcaaagtgaacac

SEQ ID NO: 2357 - DNA, 20 bp, Artificial Sequence
  source: /note="Description of Artificial Sequence: Synthetic oligonucleotide"
ttccaaagaggataaaccag

SEQ ID NO: 2358 - DNA, 20 bp, Artificial Sequence
  source: /note="Description of Artificial Sequence: Synthetic oligonucleotide"
atcagacaatatcacatgta

SEQ ID NO: 2359 - DNA, 20 bp, Artificial Sequence
  source: /note="Description of Artificial Sequence: Synthetic oligonucleotide"
ctcatacattctacaatgag

SEQ ID NO: 2360 - DNA, 20 bp, Artificial Sequence
  source: /note="Description of Artificial Sequence: Synthetic oligonucleotide"
ttccttaacaatgaatgtgg

SEQ ID NO: 2361 - DNA, 20 bp, Artificial Sequence
  source: /note="Description of Artificial Sequence: Synthetic oligonucleotide"
atgtcaagagaaacaggaga

SEQ ID NO: 2362 - DNA, 20 bp, Artificial Sequence
  source: /note="Description of Artificial Sequence: Synthetic oligonucleotide"
gatgtcaagagaaacaggag

SEQ ID NO: 2363 - DNA, 20 bp, Artificial Sequence
  source: /note="Description of Artificial Sequence: Synthetic oligonucleotide"
agatgtcaagagaaacagga

SEQ ID NO: 2364 - DNA, 20 bp, Artificial Sequence
  source: /note="Description of Artificial Sequence: Synthetic oligonucleotide"
gagatgtcaagagaaacagg

SEQ ID NO: 2365 - DNA, 20 bp, Artificial Sequence
  source: /note="Description of Artificial Sequence: Synthetic oligonucleotide"
attccaaagaggataaacca

SEQ ID NO: 2366 - DNA, 20 bp, Artificial Sequence
  source: /note="Description of Artificial Sequence: Synthetic oligonucleotide"
gattccaaagaggataaacc

SEQ ID NO: 2367 - DNA, 20 bp, Artificial Sequence
  source: /note="Description of Artificial Sequence: Synthetic oligonucleotide"
caaagtgaacaccaagcaac

SEQ ID NO: 2368 - DNA, 20 bp, Artificial Sequence
  source: /note="Description of Artificial Sequence: Synthetic oligonucleotide"
ccattccttaacaatgaatg

SEQ ID NO: 2369 - DNA, 20 bp, Artificial Sequence
  source: /note="Description of Artificial Sequence: Synthetic oligonucleotide"
atggacaagttaggaaactt

SEQ ID NO: 2370 - DNA, 20 bp, Artificial Sequence
  source: /note="Description of Artificial Sequence: Synthetic oligonucleotide"
ttaacaatgaatgtggtacc

SEQ ID NO: 2371 - DNA, 20 bp, Artificial Sequence
  source: /note="Description of Artificial Sequence: Synthetic oligonucleotide"
tcatacattctacaatgaga

SEQ ID NO: 2372 - DNA, 20 bp, Artificial Sequence
  source: /note="Description of Artificial Sequence: Synthetic oligonucleotide"
atctataaagaacagcttct

SEQ ID NO: 2373 - DNA, 20 bp, Artificial Sequence
  source: /note="Description of Artificial Sequence: Synthetic oligonucleotide"
gaagtaagtggccaaaacaa

SEQ ID NO: 2374 - DNA, 20 bp, Artificial Sequence
  source: /note="Description of Artificial Sequence: Synthetic oligonucleotide"
gccaaaacaaacacatttct

SEQ ID NO: 2375 - DNA, 20 bp, Artificial Sequence
  source: /note="Description of Artificial Sequence: Synthetic oligonucleotide"
ggacaagttaggaaacttag

SEQ ID NO: 2376 - DNA, 20 bp, Artificial Sequence
  source: /note="Description of Artificial Sequence: Synthetic oligonucleotide"
tggacaagttaggaaactta

SEQ ID NO: 2377 - DNA, 20 bp, Artificial Sequence
  source: /note="Description of Artificial Sequence: Synthetic oligonucleotide"
aatttaatctcaacttctgt

SEQ ID NO: 2378 - DNA, 20 bp, Artificial Sequence
  source: /note="Description of Artificial Sequence: Synthetic oligonucleotide"
cattccttaacaatgaatgt

SEQ ID NO: 2379 - DNA, 20 bp, Artificial Sequence
  source: /note="Description of Artificial Sequence: Synthetic oligonucleotide"
gatcacatgtacttttaatg

SEQ ID NO: 2380 - DNA, 20 bp, Artificial Sequence
  source: /note="Description of Artificial Sequence: Synthetic oligonucleotide"
caatcattacaaatcagctt

SEQ ID NO: 2381 - DNA, 20 bp, Artificial Sequence
  source: /note="Description of Artificial Sequence: Synthetic oligonucleotide"
cagagatgtcaagagaaaca

SEQ ID NO: 2382 - DNA, 20 bp, Artificial Sequence
  source: /note="Description of Artificial Sequence: Synthetic oligonucleotide"
aatcattacaaatcagcttc

SEQ ID NO: 2383 - DNA, 20 bp, Artificial Sequence
  source: /note="Description of Artificial Sequence: Synthetic oligonucleotide"
gatgattccaaagaggataa

SEQ ID NO: 2384 - DNA, 20 bp, Artificial Sequence
  source: /note="Description of Artificial Sequence: Synthetic oligonucleotide"
ccaaagaggataaaccagaa

SEQ ID NO: 2385 - DNA, 20 bp, Artificial Sequence
  source: /note="Description of Artificial Sequence: Synthetic oligonucleotide"
ctaggatctagaatcataac

SEQ ID NO: 2386 - DNA, 20 bp, Artificial Sequence
  source: /note="Description of Artificial Sequence: Synthetic oligonucleotide"
catacattctacaatgagat

SEQ ID NO: 2387 - DNA, 20 bp, Artificial Sequence
  source: /note="Description of Artificial Sequence: Synthetic oligonucleotide"
cctggtatatctataaagaa

SEQ ID NO: 2388 - DNA, 20 bp, Artificial Sequence
  source: /note="Description of Artificial Sequence: Synthetic oligonucleotide"
agagatgtcaagagaaacag

SEQ ID NO: 2389 - DNA, 20 bp, Artificial Sequence
  source: /note="Description of Artificial Sequence: Synthetic oligonucleotide"
attccttaacaatgaatgtg

SEQ ID NO: 2390 - DNA, 20 bp, Artificial Sequence
  source: /note="Description of Artificial Sequence: Synthetic oligonucleotide"
ttttatagatggaactatgg

SEQ ID NO: 2391 - DNA, 20 bp, Artificial Sequence
  source: /note="Description of Artificial Sequence: Synthetic oligonucleotide"
tcctgtatgatattaagaat

SEQ ID NO: 2392 - DNA, 20 bp, Artificial Sequence
  source: /note="Description of Artificial Sequence: Synthetic oligonucleotide"
cttaacaatgaatgtggtac

SEQ ID NO: 2393 - DNA, 20 bp, Artificial Sequence
  source: /note="Description of Artificial Sequence: Synthetic oligonucleotide"
tcagcaaactgaaacaaacc

SEQ ID NO: 2394 - DNA, 20 bp, Artificial Sequence
  source: /note="Description of Artificial Sequence: Synthetic oligonucleotide"
agcaaactgaaacaaacctt

SEQ ID NO: 2395 - DNA, 20 bp, Artificial Sequence
  source: /note="Description of Artificial Sequence: Synthetic oligonucleotide"
tatctataaagaacagcttc

SEQ ID NO: 2396 - DNA, 20 bp, Artificial Sequence
  source: /note="Description of Artificial Sequence: Synthetic oligonucleotide"
atacattctacaatgagatg

SEQ ID NO: 2397 - DNA, 20 bp, Artificial Sequence
  source: /note="Description of Artificial Sequence: Synthetic oligonucleotide"
aagtaagtggccaaaacaaa

SEQ ID NO: 2398 - DNA, 20 bp, Artificial Sequence
  source: /note="Description of Artificial Sequence: Synthetic oligonucleotide"
cattttatagatggaactat

SEQ ID NO: 2399 - DNA, 20 bp, Artificial Sequence
  source: /note="Description of Artificial Sequence: Synthetic oligonucleotide"
caaacacatttctgtgaaat

SEQ ID NO: 2400 - DNA, 20 bp, Artificial Sequence
  source: /note="Description of Artificial Sequence: Synthetic oligonucleotide"
gtatatctataaagaacagc

SEQ ID NO: 2401 - DNA, 20 bp, Artificial Sequence
  source: /note="Description of Artificial Sequence: Synthetic oligonucleotide"
cttcagcaaactgaaacaaa

SEQ ID NO: 2402 - DNA, 20 bp, Artificial Sequence
  source: /note="Description of Artificial Sequence: Synthetic oligonucleotide"
attttatagatggaactatg

SEQ ID NO: 2403 - DNA, 20 bp, Artificial Sequence
  source: /note="Description of Artificial Sequence: Synthetic oligonucleotide"
tatatctataaagaacagct

SEQ ID NO: 2404 - DNA, 20 bp, Artificial Sequence
  source: /note="Description of Artificial Sequence: Synthetic oligonucleotide"
ctggtatatctataaagaac

SEQ ID NO: 2405 - DNA, 20 bp, Artificial Sequence
  source: /note="Description of Artificial Sequence: Synthetic oligonucleotide"
ggtatatctataaagaacag

SEQ ID NO: 2406 - DNA, 20 bp, Artificial Sequence
  source: /note="Description of Artificial Sequence: Synthetic oligonucleotide"
tggtatatctataaagaaca

SEQ ID NO: 2407 - DNA, 20 bp, Artificial Sequence
  source: /note="Description of Artificial Sequence: Synthetic oligonucleotide"
ttcagcaaactgaaacaaac

SEQ ID NO: 2408 - DNA, 20 bp, Artificial Sequence
  source: /note="Description of Artificial Sequence: Synthetic oligonucleotide"
ctgtatgatattaagaatta

SEQ ID NO: 2409 - DNA, 20 bp, Artificial Sequence
  source: /note="Description of Artificial Sequence: Synthetic oligonucleotide"
gatattaagaattatatttc

SEQ ID NO: 2410 - DNA, 20 bp, Artificial Sequence
  source: /note="Description of Artificial Sequence: Synthetic oligonucleotide"
  source: /note="Description of Combined DNA/RNA Molecule: Synthetic oligonucleotide"
  misc_feature (1)..(2): /note="RNA (2'-MOE), phosphorothioate bond"
  misc_feature (2)..(3): /note="RNA (2'-MOE), phosphodiester bond"
  misc_feature (3)..(4): /note="RNA (2'-MOE), phosphorothioate bond"
  misc_feature (4)..(5): /note="RNA (2'-MOE), phosphodiester bond"
  misc_feature (5)..(6): /note="RNA (2'-MOE), phosphorothioate bond"
  misc_feature (6)..(7): /note="DNA, phosophorothioate bond"
  misc_feature (7)..(8): /note="DNA, phosophorothioate bond"
  misc_feature (8)..(9): /note="DNA, phosophorothioate bond"
  misc_feature (9)..(10): /note="DNA, phosophorothioate bond"
  misc_feature (10)..(11): /note="DNA, phosophorothioate bond"
  misc_feature (11)..(12): /note="DNA, phosophorothioate bond"
  misc_feature (12)..(13): /note="DNA, phosophorothioate bond"
  misc_feature (13)..(14): /note="DNA, phosophorothioate bond"
  misc_feature (14)..(15): /note="DNA, phosophorothioate bond"
  misc_feature (15)..(16): /note="DNA, phosophorothioate bond"
  misc_feature (16)..(17): /note="RNA (2'-MOE), phosphodiester bond"
  misc_feature (17)..(18): /note="RNA (2'-MOE), phosphorothioate bond"
  misc_feature (18)..(19): /note="RNA (2'-MOE), phosphodiester bond"
  misc_feature (19)..(20): /note="RNA (2'-MOE), phosphorothioate bond"
gcacagcctgcatgtcctca

SEQ ID NO: 2411 - DNA, 20 bp, Artificial Sequence
  source: /note="Description of Artificial Sequence: Synthetic oligonucleotide"
  source: /note="Description of Combined DNA/RNA Molecule: Synthetic oligonucleotide "
  misc_feature (1)..(2): /note="RNA (2'-MOE), phosphorothioate bond"
  misc_feature (2)..(3): /note="RNA (2'-MOE), phosphodiester bond"
  misc_feature (3)..(4): /note="RNA (2'-MOE), phosphorothioate bond"
  misc_feature (4)..(5): /note="RNA (2'-MOE), phosphodiester bond"
  misc_feature (5)..(6): /note="RNA (2'-MOE), phosphorothioate bond"
  misc_feature (6)..(7): /note="DNA, phosophorothioate bond"
  misc_feature (7)..(8): /note="DNA, phosophorothioate bond"
  misc_feature (8)..(9): /note="DNA, phosophorothioate bond"
  misc_feature (9)..(10): /note="DNA, phosophorothioate bond"
  misc_feature (10)..(11): /note="DNA, phosophorothioate bond"
  misc_feature (11)..(12): /note="DNA, phosophorothioate bond"
  misc_feature (12)..(13): /note="DNA, phosophorothioate bond"
  misc_feature (13)..(14): /note="DNA, phosophorothioate bond"
  misc_feature (14)..(15): /note="DNA, phosophorothioate bond"
  misc_feature (15)..(16): /note="DNA, phosophorothioate bond"
  misc_feature (16)..(17): /note="RNA (2'-MOE), phosphodiester bond"
  misc_feature (17)..(18): /note="RNA (2'-MOE), phosphorothioate bond"
  misc_feature (18)..(19): /note="RNA (2'-MOE), phosphodiester bond"
  misc_feature (19)..(20): /note="RNA (2'-MOE), phosphorothioate bond"
gcccaggcccttgctcagaa

SEQ ID NO: 2412 - DNA, 20 bp, Artificial Sequence
  source: /note="Description of Artificial Sequence: Synthetic oligonucleotide"
  source: /note="Description of Combined DNA/RNA Molecule: Synthetic oligonucleotide "
  misc_feature (1)..(2): /note="RNA (2'-MOE), phosphorothioate bond"
  misc_feature (2)..(3): /note="RNA (2'-MOE), phosphodiester bond"
  misc_feature (3)..(4): /note="RNA (2'-MOE), phosphorothioate bond"
  misc_feature (4)..(5): /note="RNA (2'-MOE), phosphodiester bond"
  misc_feature (5)..(6): /note="RNA (2'-MOE), phosphorothioate bond"
  misc_feature (6)..(7): /note="DNA, phosophorothioate bond"
  misc_feature (7)..(8): /note="DNA, phosophorothioate bond"
  misc_feature (8)..(9): /note="DNA, phosophorothioate bond"
  misc_feature (9)..(10): /note="DNA, phosophorothioate bond"
  misc_feature (10)..(11): /note="DNA, phosophorothioate bond"
  misc_feature (11)..(12): /note="DNA, phosophorothioate bond"
  misc_feature (12)..(13): /note="DNA, phosophorothioate bond"
  misc_feature (13)..(14): /note="DNA, phosophorothioate bond"
  misc_feature (14)..(15): /note="DNA, phosophorothioate bond"
  misc_feature (15)..(16): /note="DNA, phosophorothioate bond"
  misc_feature (16)..(17): /note="RNA (2'-MOE), phosphodiester bond"
  misc_feature (17)..(18): /note="RNA (2'-MOE), phosphorothioate bond"
  misc_feature (18)..(19): /note="RNA (2'-MOE), phosphodiester bond"
  misc_feature (19)..(20): /note="RNA (2'-MOE), phosphorothioate bond"
aggttgtctcagcccaggga

The invention claimed is:

1. An antisense oligonucleotide comprising a sequence having at least 95% identity to a sequence selected from a group consisting of SEQ ID NO: 4-10, 12-14, 18-21, 23-26, and 38.

2. The antisense oligonucleotide of claim 1, comprising a sequence selected from the group consisting of SEQ ID NO: 4-10, 12-14, 18-21, 23-26, and 38.

3. The antisense oligonucleotide of claim 2, wherein the antisense oligonucleotide comprises one or more modifications.

4. The antisense oligonucleotide of claim 3, wherein the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof.

5. An antisense oligonucleotide comprising a sequence having at least 95% identity to a sequence selected from a group consisting of SEQ ID NO: 3-21, 23-26, 38 and 39, wherein the antisense oligonucleotide comprises one or more modifications, the one or more modifications comprise methylphosphonothioate internucleotide linkages, phosphorothioate internucleotide linkages, methylphosphonate internucleotide linkages, phosphoramidate internucleotide linkages, a 3' end cap, a 3' hair-pin loop structure, or a combination thereof and the antisense oligonucleotide comprises internucleotide linkages of the pattern $R_S R_O R_S R_O R_S$ $D_S D_S D_S D_S D_S D_S D_S D_S D_S D_S R_O R_S R_O R_S$, wherein $R_S$ is an RNA (2'-MOE) phosphorothioate bond, $R_O$ is an RNA (2'-MOE) phosphodiester bond and $D_S$ is a DNA phosphorothioate bond.

6. An antisense oligonucleotide comprising a sequence selected from the group consisting of SEQ ID NO: 2410-2412, wherein the antisense oligonucleotide comprises internucleotide linkages of the pattern $R_S R_O R_S R_O R_S$ $D_S D_S D_S D_S D_S D_S D_S D_S D_S D_S R_O R_S R_O R_S$, wherein $R_S$ is an RNA (2'-MOE) phosphorothioate bond, $R_O$ is an RNA (2'-MOE) phosphodiester bond and $D_S$ is a DNA phosphorothioate bond.

7. A pharmaceutical composition comprising the antisense oligonucleotide of claim 1.

8. A pharmaceutical composition comprising the antisense oligonucleotide of claim 5.

9. A pharmaceutical composition comprising the antisense oligonucleotide of claim 6.

10. A method of treating or preventing axonal degeneration in a subject, comprising administering to the subject the antisense oligonucleotide of claim 1.

11. A method of treating or preventing axonal degeneration in a subject, comprising administering to the subject the antisense oligonucleotide of claim 5.

12. A method of treating or preventing axonal degeneration in a subject, comprising administering to the subject the antisense oligonucleotide of claim 6.

13. The method of claim 10, wherein administering the antisense oligonucleotide decreases levels of SARM1 mRNA in the subject.

14. The method of claim 11, wherein administering the antisense oligonucleotide decreases levels of SARM1 mRNA in the subject.

15. The method of claim 12, wherein administering the antisense oligonucleotide decreases levels of SARM1 mRNA in the subject.

16. The method of claim 10, wherein administering the antisense oligonucleotide decreases levels of SARM1 protein in the subject.

17. The method of claim 11, wherein administering the antisense oligonucleotide decreases levels of SARM1 protein in the subject.

18. The method of claim 12, wherein administering the antisense oligonucleotide decreases levels of SARM1 protein in the subject.

* * * * *